US012258371B2

(12) United States Patent
Deak Codarri et al.

(10) Patent No.: US 12,258,371 B2
(45) Date of Patent: Mar. 25, 2025

(54) STABILIZED IMMUNOGLOBULIN DOMAINS

(71) Applicant: Hoffmann-La Roche Inc., Little Falls, NJ (US)

(72) Inventors: Laura Deak Codarri, Schlieren (CH); Stefan Dengl, Penzberg (DE); Jens Fischer, Penzberg (DE); Thomas Hofer, Schlieren (CH); Laurent Lariviere, Penzberg (DE); Ekkehard Moessner, Schlieren (CH); Stefan Seeber, Penzberg (DE); Pablo Umana, Schlieren (CH); Anne-Claire Zagdoun, Schlieren (CH)

(73) Assignee: Hoffman-La Roche Inc., Little Falls, NJ (US)

( * ) Notice: Subject to any disclaimer, the term of this patent is extended or adjusted under 35 U.S.C. 154(b) by 1182 days.

(21) Appl. No.: 16/943,067

(22) Filed: Jul. 30, 2020

(65) Prior Publication Data
US 2021/0054021 A1 Feb. 25, 2021

Related U.S. Application Data

(63) Continuation of application No. PCT/EP2019/052162, filed on Jan. 30, 2019.

(30) Foreign Application Priority Data

Jan. 31, 2018 (EP) ..................................... 18154316

(51) Int. Cl.
C07K 16/28 (2006.01)
C07K 1/04 (2006.01)
C07K 16/30 (2006.01)
C07K 16/40 (2006.01)

(52) U.S. Cl.
CPC .......... C07K 1/047 (2013.01); C07K 16/2803 (2013.01); C07K 16/2818 (2013.01); C07K 16/2881 (2013.01); C07K 16/3007 (2013.01); C07K 16/3053 (2013.01); C07K 16/40 (2013.01); C07K 2317/21 (2013.01); C07K 2317/56 (2013.01); C07K 2317/92 (2013.01); C07K 2317/94 (2013.01)

(58) Field of Classification Search
None
See application file for complete search history.

(56) References Cited

U.S. PATENT DOCUMENTS

| 4,676,980 | A | 6/1987 | Segal et al. |
| 5,571,894 | A | 11/1996 | Wels et al. |
| 5,587,458 | A | 12/1996 | King et al. |
| 5,731,168 | A | 3/1998 | Carter et al. |
| 5,821,333 | A | 10/1998 | Carter et al. |
| 5,869,046 | A | 2/1999 | Presta et al. |
| 6,248,516 | B1 | 6/2001 | Winter et al. |
| 7,695,936 | B2 | 4/2010 | Carter et al. |
| 2004/0101920 | A1 | 5/2004 | Radziejewski et al. |
| 2008/0069820 | A1 | 3/2008 | Fuh et al. |
| 2011/0150892 | A1 | 6/2011 | Thudium et al. |
| 2015/0158934 | A1* | 6/2015 | McCoy .............. C07K 16/1045 435/69.6 |
| 2016/0145354 | A1* | 5/2016 | Bacac .................... C07K 16/32 435/254.2 |

FOREIGN PATENT DOCUMENTS

| EP | 0404097 B1 | 9/1996 |
| EP | 2101823 B1 | 11/2016 |
| WO | 93/01161 A1 | 1/1993 |
| WO | 93/16185 A2 | 8/1993 |
| WO | 98/050431 A2 | 11/1998 |
| WO | 01/77342 A1 | 10/2001 |
| WO | 02/020565 A2 | 3/2002 |
| WO | 2004/106381 A1 | 12/2004 |
| WO | 2005/061547 A2 | 7/2005 |
| WO | 2006/068953 A2 | 6/2006 |
| WO | 2007/042261 A2 | 4/2007 |
| WO | 2008/024715 A2 | 2/2008 |
| WO | 2008/119567 A2 | 10/2008 |
| WO | 2009/080251 A1 | 7/2009 |
| WO | 2009/080252 A1 | 7/2009 |
| WO | 2009/080253 A1 | 7/2009 |
| WO | 2009/089004 A1 | 7/2009 |
| WO | 2010/115589 A1 | 10/2010 |
| WO | 2010/136172 A1 | 12/2010 |
| WO | 2010/145792 A1 | 12/2010 |
| WO | 2010/145792 A8 | 12/2010 |
| WO | 2011/034605 A2 | 3/2011 |
| WO | 2012/100343 A1 | 8/2012 |

(Continued)

OTHER PUBLICATIONS

Atwell, S., et al., "Stable Heterodimers from Remodeling the Domain Interface of a Homodimer using a Phage Display Library" J Mol Biol 270(1):26-35 (Jul. 4, 1997).
Bacac, M. et al., "CEA TCB: a novel head-to-tail 2: 1 T cell bispecific antibody for treatment of CEA-positive solid tumors" Oncoimmunology 5(8):e1203498 (1-3) (Aug. 1, 2016).
Barthelemy, P., et al., "Comprehensive Analysis of the Factors Contributing to the Stability and Solubility of Autonomous Human VH Domains" J Biol Chem 283(6):3639-3654 (Feb. 8, 2008).
Brennan, M. et al., "Preparation of bispecific antibodies by chemical recombination of monoclonal immunoglobulin G1 fragments" Science 229( Suppl 4708):81-83 (Jul. 5, 1985).

(Continued)

Primary Examiner — Christopher M Gross
(74) Attorney, Agent, or Firm — Nicole M. Fortuné

(57) ABSTRACT

The invention relates autonomous VH domains (aVH) with cysteines in positions 52a and 71 or in positions 33 and 52 in order to stabilize the autonomous VH domains. Said cysteines are capable of forming a disulfide bond and/or form a disulfide bond under suitable conditions. The invention further relates to aVH libraries.

10 Claims, 10 Drawing Sheets
Specification includes a Sequence Listing.

(56) References Cited

FOREIGN PATENT DOCUMENTS

| WO | 2012/130831 A1 | 10/2012 |
|---|---|---|
| WO | 2013/026831 A1 | 2/2013 |
| WO | 2013/026833 A1 | 2/2013 |
| WO | 2013/026839 A1 | 2/2013 |
| WO | 2013/036130 A1 | 3/2013 |
| WO | 2014/008218 A1 | 1/2014 |
| WO | 2014/131694 A1 | 9/2014 |
| WO | 2015/095539 A1 | 6/2015 |
| WO | 2015/150447 A1 | 10/2015 |
| WO | 2016/016299 A1 | 2/2016 |
| WO | 2016/020309 A1 | 2/2016 |
| WO | 2016/172485 A2 | 10/2016 |
| WO | 2018/102589 A2 | 7/2018 |

OTHER PUBLICATIONS

Carter, P., et al., "Bispecific human IgG by design" J Immunol Methods 248(1-2):7-15 (Feb. 1, 2001).
Chan, P., et al., "Engineering a Camelid Antibody Fragment That Binds to the Active Site of Human Lysozyme and Inhibits Its Conversion into Amyloid Fibrils" ACS Biochemistry 47(42):11041-11054 (Sep. 25, 2008).
Davies, J., et al., "Single antibody domains as small recognition units: design and in vitro antigen selection of camelized, human VH domains with improved protein stability" Protein Eng Des Sel 9(6):531-537 (Jun. 1, 1996).
Genbank et al., Other Database, AAM89752, Accession: AF397387. 1, pp. 1-2;Creation Date Jul. 24, 2016.
Gruber, M. et al., "Efficient tumor cell lysis mediated by a bispecific single chain antibody expressed in Escherichia coli" J Immunol 152(11):5368-5374 (Jun. 1, 1994).
Hagihara, Y. et al., "Stabilization of an immunoglobulin fold domain by an engineered disulfide bond at the buried hydrophobic region" J Biol Chem 282(50):36489-36495 (Dec. 14, 2007).
Heeley, R. et al., "Mutations Flanking the Polyglutamine Repeat in the Modulatory Domain of Rat Glucocorticoid Receptor Lead to an Increase in Affinity for Hormone" Endocr Res 28(3):217-229 (Aug. 1, 2002).
Hochleitner, E. O., et al., "Characterization of a discontinuous epitope of the human immunodeficiency virus (HIV) core protein p24 by epitope excision and differential chemical modification followed by mass spectrometric peptide mapping analysis" Protein Sci 9(3):487-496 (Mar. 1, 2000).
Holliger, P., et al., "'Diabodies': Small bivalent and bispecific antibody fragments" PNAS USA 90(14):6444-6448 (Jul. 15, 1993).
Holliger, P., et al., "Specific killing of lymphoma cells by cytotoxic T-cells mediated by a bispecific diabody" Protein Eng 9(3):299-305 (Mar. 1, 1996).
Hudson, P., et al., "Engineered antibodies" Nat Med 9(1):129-134 (Jan. 1, 2003).
Hussack, G., et al., "Engineered Single-Domain Antibodies with High Protease Resistance and Thermal Stability" PLOS One 6(11):e28218 (1-15) (Nov. 30, 2011).
Huston, J. et al., "Protein Engineering of Single-Chain Fv Analogs and Fusion Proteins" Methods in Enzymology 203:46-96 (1991).
"International Preliminary Report on Patentability—PCT/EP2019/052162" (Report Issuance Date: Aug. 4, 2020—Chapter I),:pp. 1-12 (Aug. 13, 2020).
"International Search Report—PCT/EP2019/052162" (w/Written Opinion),:pp. 1-18 (Apr. 8, 2019).
Johnson, S., et al., "Effector Cell Recruitment with Novel Fv-based Dual-affinity Re-targeting Protein Leads to Potent Tumor Cytolysis and in Vivo B-cell Depletion" J Mol Biol 399(3):436-449 (Jun. 11, 2010).

Kabat, E., et al. Sequences of Proteins of Immunological Interest (book not provided.), 5th edition, Bethesda, MD: Public Health Service, National Institute of Health, ( 1991).
Kim, D., et al., "Disulfide linkage engineering for improving biophysical properties of human VH domains" Protein Eng Des Sel (Epub: Aug. 30, 2012), 25(10):581-589 (Oct. 1, 2012).
Kipriyanov, S., et al., "Bispecific Tandem Diabody for Tumor Therapy with Improved Antigen Binding and Pharmacokinetics" J Mol Biol 293(1):41-56 (Oct. 15, 1999).
Klein, C. et al., "The use of CrossMAb technology for the generation of bi- and multispecific antibodies" MABS 8(6):1010-1020 (Aug. 31, 2016).
Kostelny, S., et al., "Formation of a bispecific antibody by the use of leucine zippers" J Immunol 148(5):1547-1553 (Mar. 1, 1992).
Liljeblad, M., et al., "Analysis of agalacto-IgG in rheumatoid arthritis using surface plasmon resonance" Glycoconjugate J 17:323-329 (Jul. 14, 2000).
Milstein, C., et al., "Hybrid hybridomas and their use in immunohistochemistry" Nature 305(5934):537-540 (Oct. 6, 1983).
Nagorsen, D., et al., "Immunomodulatory therapy of cancer with T cell-engaging BiTE antibody blinatumomab" Exp Cell Res 317(9):1255-1260 (May 15, 2011).
Pluckthun, A. et al. The Pharmacology of Monoclonal Antibodies "Antibodies from Escherichia coli" Rosenberg & Moore, vol. 113:269-315 (1994).
Reineke, U et al. Methods in Molecular Biology "Chapter 26: Antibody Epitope Mapping Using Arrays of Synthetic Peptides" Lo, B.K.C., ed., First edition, Totowa, New Jersey—US: Humana Press Inc., vol. 248:443-463 (Jan. 1, 2004).
Ridgway, J., et al., "Knobs-into-holes' engineering of antibody CH3 domains for heavy chain heterodimerization" Protein Eng 9(7):617-621 (Jul. 1, 1996).
Saerens, D., et al., "Disulfide Bond Introduction for General Stabilization of Immunoglobulin Heavy-Chain Variable Domains" J Mol Biol (Epub: Jan. 16, 2008), 377(2):478-488 (Mar. 21, 2008).
Saerens, D., et al., "Single Domain Antibodies Derived from Dromedary Lymph Node and Peripheral Blood Lymphocytes Sensing Conformational Variants of Prostate-specific Antigen" J Biol Chem 279(50):51965-51972 (Dec. 1, 2004).
Schaefer, W., et al., "Immunoglobulin domain crossover as a generic approach for the production of bispecific IgG antibodies" PNAS USA 108(27):11187-11192 (Jul. 5, 2011).
Seimetz, D., et al., "Development and approval of the trifunctional antibody catumaxomab (anti-EpCAM x anti-CD3) as a target cancer immunotherapy" Cancer Treat Rev 36(6):458-467 (Oct. 1, 2010).
Spiess, C., et al., "Alternative molecular formats and therapeutic applications for bispecific antibodies" Mol Immunol (Epub: Jan. 27, 2015), 67( Suppl 2 Pt A):95-106 (Oct. 1, 2015).
Stadler, C., et al., "Elimination of large tumors in mice by mRNA-encoded bispecific antibodies" Nat Med 23(7):815-817 (Jun. 12, 2017).
Tutt, A., et al., "Trispecific F(ab')3 derivatives that use cooperative signaling via the TCR/CD3 complex and CD2 to activate and redirect resting cytotoxic T cells" J Immunol 147(1):60-69 (Jul. 1, 1991).
Von Budingen, H. C. et al., NCBI Database, AAM89752,"Immunoglobulin heavy chain variable region, partial [Callithrix jacchus]," Creation Date Jul. 24, 2016.
Ward, E., et al., "Binding activities of a repertoire of single immunoglobulin variable domains secreted from Escherichia coli" Nature 341(6242):544-546 (Oct. 12, 1989).
Yang, F. et al., NCBI Database, AY238378,"Ictalurus punctatus immunoglobulin heavy chain variable region gene, partial cds," pp. 1; Creation Date Oct. 23, 2016.

* cited by examiner

Herceptin  evqlvesggglvqpggslrlscaasgftnikdtyihwvrqapgkglewvariyptngytryadsvkgrftisadtskntaylqmnslraedtavyycsrwggdgfyamdywgqgtlvtvss
B1ab      evqlvesggglvqpggslrlscaasgfnikdtyihwvrqapgkglewvariyptngytryadsvkgrftisadtskntaylqmnslraedtavyycsrwggdgfyamdywgqgtlvtvss (SEQ ID NO. 14)

FIG. 1A

| Kabat VH | 85 | 86 | 87 | 88 | 89 | 90 | 91 | 92 | 93 | 94 | 95 | 96 | 97 | 98 | 99 | 100 | 100a | 100b | 100c | 101 | 102 | 103 | 104 | 105 | 106 | 107 | 108 | 109 | 110 | 111 | 112 | 113 |
|---|---|---|---|---|---|---|---|---|---|---|---|---|---|---|---|---|---|---|---|---|---|---|---|---|---|---|---|---|---|---|---|---|
| | E | D | T | A | V | Y | Y | C | A | X | X | X | X | X | X | | | | | D | Y | W | G | Q | G | T | L | V | T | V | S | S |
| | E | D | T | A | V | Y | Y | C | A | X | X | X | X | X | X | X | | | | D | Y | W | G | Q | G | T | L | V | T | V | S | S |
| | E | D | T | A | V | Y | Y | C | A | X | X | X | X | X | X | X | X | X | X | D | Y | W | G | Q | G | T | L | V | T | V | S | S |

FIG. 1B

SEQ ID NO 37
(P52aC A71C)   evqlvesgggglvqpggslrlscaasgfnikd-tigwvrrapgkgtelvaricptngytryadsvkgrftisadtskntaylqmnslraedtavyycakyvrryfdywgqgtlvtvss
               vdggsptpptpggsadkthtcppcpapellgpsvflfppkpkdtlmisrtpevtcvvvdvshedpevkfnwyvdgvevhnaktkpreeqynstyrvvsvltvihqdwlngkeykc
               kvsnkalpapiektiskakgqprepqvytlppcrdeltknqvslwclvkgfypsdiavewesngqpennykttppvldsdgsfflyskltvdksrwqqgnvfscsvmhealhnhytq
               kslslspgksggindifeaqkiewhe Template 1
(P52aC A71C)   evqlvesgggglvqpggslrlscaasgfnikd--tyigwvrrapgkgtelvariyctngytryadsvkgrftiscdtskntaylqmnslraedtavyycasyvrryfdywgqgttvtvss    (SEQ ID
                                                                                                                                              NO.40)

Template 2
(P52aC
A71C G26S)     evqlvesgggglvqpggslrlscaasgfnikd--tyigwvrrapgkgtelvariyctngytryadsvkgrftiscdtskntaylqmnslraedtavyycasyvrryfdywgqgttvtvss    (SEQ ID
                                                                                                                                              NO.42)

Template 3
(P52aC
A71C 31aS)     evqlvesgggglvqpggslrlscaasgfnikd--tyigwvrrapgkgtelvariyctngytryadsvkgrftiscdtskntaylqmnslraedtavyycasyvrryfdywgqgttvtvss    (SEQ ID
                                                                                                                                              NO.44)

Template 4
(P52aC
A71C 31aS
31bS)          evqlvesgggglvqpggslrlscaasgfnikdsstyigwvrrapgkgtelvariyctngytryadsvkgrftiscdtskntaylqmnslraedtavyycasyvrryfdywgqgttvtvss   (SEQ ID
                                                                                                                                              NO.46)

FIG. 3A

SEQ ID NO 30
(Y33C Y52C)    evqlvesgggglvqpggslrlscaasgfnikdtyigwvrrapgkgtelvariyctngytryadsvkgrftiscdtskntaylqmnslraedtavyycakyvrryfdywgqgtlvtvss
               vdggsptpptpggsadkthtcppcpapellgpsvflfppkpkdtlmisrtpevtcvvvdvshedpevkfnwyvdgvevhnaktkpreeqynstyrvvsltvihqdwlngkeyk
               ckvsnkalpapiektiskakgqprepqvytlppcrdeltknqvslwclvkgfypsdiavewesngqpennykttppvldsdgsfflyskltvdksrwqqgnvfscsvmhealhnhy
               tqkslslspgksggindifeaqkiewhe Template 5
(Y33C Y52C)    evqlvesgggglvqpggslrlscaasgfnikdtcigwvrrapgkgtelvariyctngytryadsvkgrftisadtskntaylqmnslraedtavyycasyvrryfdywgqgttvtvss    (SEQ ID
                                                                                                                                              NO.180)

FIG. 3B

```
Template(6H1)   EVQLVESGGGLVQPGGSLRLSCAASSFNIKDTYIGWVRRAPGKGTELVAYIQCYGGATRYADSVKGRFTISCDTSKNTAYLQMNSLRAEDTAVYYCAAPSEYFAYWGQGTTVTVSS
6H1_V5Q         EVQLQESGGGLVQPGGSLRLSCAASSFNIKDTYIGWVRRAPGKGTELVAYIQCYGGATRYADSVKGRFTISCDTSKNTAYLQMNSLRAEDTAVYYCAAPSEYFAYWGQGTTVTVSS
6H1_L11S        EVQLVESGGGSVQPGGSLRLSCAASSFNIKDTYIGWVRRAPGKGTELVAYIQCYGGATRYADSVKGRFTISCDTSKNTAYLQMNSLRAEDTAVYYCAAPSEYFAYWGQGTTVTVSS
6H1_F27Y        EVQLVESGGGLVQPGGSLRLSCAASSYNIKDTYIGWVRRAPGKGTELVAYIQCYGGATRYADSVKGRFTISCDTSKNTAYLQMNSLRAEDTAVYYCAAPSEYFAYWGQGTTVTVSS
6H1_R39Q        EVQLVESGGGLVQPGGSLRLSCAASSFNIKDTYIGWVRQAPGKGTELVAYIQCYGGATRYADSVKGRFTISCDTSKNTAYLQMNSLRAEDTAVYYCAAPSEYFAYWGQGTTVTVSS
6H1_G44E        EVQLVESGGGLVQPGGSLRLSCAASSFNIKDTYIGWVRRAPGKETELVAYIQCYGGATRYADSVKGRFTISCDTSKNTAYLQMNSLRAEDTAVYYCAAPSEYFAYWGQGTTVTVSS
6H1_T45E        EVQLVESGGGLVQPGGSLRLSCAASSFNIKDTYIGWVRRAPGKGEELVAYIQCYGGATRYADSVKGRFTISCDTSKNTAYLQMNSLRAEDTAVYYCAAPSEYFAYWGQGTTVTVSS
6H1_T45R        EVQLVESGGGLVQPGGSLRLSCAASSFNIKDTYIGWVRRAPGKGRELVAYIQCYGGATRYADSVKGRFTISCDTSKNTAYLQMNSLRAEDTAVYYCAAPSEYFAYWGQGTTVTVSS
6H1_R58Y        EVQLVESGGGLVQPGGSLRLSCAASSFNIKDTYIGWVRRAPGKGTELVAYIQCYGGATYYADSVKGRFTISCDTSKNTAYLQMNSLRAEDTAVYYCAAPSEYFAYWGQGTTVTVSS
6H1_A84P        EVQLVESGGGLVQPGGSLRLSCAASSFNIKDTYIGWVRRAPGKGTELVAYIQCYGGATRYADSVKGRFTISCDTSKNTAYLQMNSLRPEDTAVYYCAAPSEYFAYWGQGTTVTVSS
6H1_A84S        EVQLVESGGGLVQPGGSLRLSCAASSFNIKDTYIGWVRRAPGKGTELVAYIQCYGGATRYADSVKGRFTISCDTSKNTAYLQMNSLRSEDTAVYYCAAPSEYFAYWGQGTTVTVSS
6H1_V89T        EVQLVESGGGLVQPGGSLRLSCAASSFNIKDTYIGWVRRAPGKGTELVAYIQCYGGATRYADSVKGRFTISCDTSKNTAYLQMNSLRAEDTAYYCAAPSEYFAYWGQGTTVTVSS
6H1_F(101-1)Y   EVQLVESGGGLVQPGGSLRLSCAASSFNIKDTYIGWVRRAPGKGTELVAYIQCYGGATRYADSVKGRFTISCDTSKNTAYLQMNSLRAEDTAVYYCAAPSEYYAYWGQGTTVTVSS
6H1_A101D       EVQLVESGGGLVQPGGSLRLSCAASSFNIKDTYIGWVRRAPGKGTELVAYIQCYGGATRYADSVKGRFTISCDTSKNTAYLQMNSLRAEDTAVYYCAAPSEYFDYWGQGTTVTVSS
6H1_T108Q       EVQLVESGGGLVQPGGSLRLSCAASSFNIKDTYIGWVRRAPGKGTELVAYIQCYGGATRYADSVKGRFTISCDTSKNTAYLQMNSLRAEDTAVYYCAAPSEYFAYWGQGTQVTVSS
6H1_combo       EVQLQESGGGSVQPGGSLRLSCAASSYNIKDTYIGWVRQAPGKETELVAYIQCYGGATYYADSVKGRFTISCDTSKNTAYLQMNSLRSEDTAYYCAAPSEYFDYWGQGTQVTVSS
```

*FIG. 6*

Phagemid template G44E_T45E_F(101-1)Y_Y33C_Y52C
EVQLVESGGGLVQPGGSLRLSCAASGFNIKDTCIGWVRRAPGKEEELVAEICQDIGYTRYADSVKGRFTISADTSKNTAYLQMNSLRAEDTAVYYCAAVEVAEYYEYWGQGTTVTVSS Phagemid template G44E_T45E_F(101-1)Y_P52aC_A71C_S31ab
EVQLVESGGGLVQPGGSLRLSCAASGFNIKDSSTYIGWVRRAPGKEEELVAEIYCDIGYTRYADSVKGRFTISCDTSKNTAYLQMNSLRAEDTAVYYCAAVEVAEYYEYWGQGTTVTVSS Phagemid template G44E_T45E_F(101-1)Y_P52aC_A71C_G26S
EVQLVESGGGLVQPGGSLRLSCAASSFNIKDTYIGWVRRAPGKEEELVAEIYCDIGYTRYADSVKGRFTISCDTSKNTAYLQMNSLRAEDTAVYYCAAVEVAEYYEYWGQGTTVTVSS

FIG. 7A

Phagemid template G44E_T45E_F(101-1)Y_Y33C_Y52C
EVQLVESGGGLVQPGGSLRLSCAASGFNIKDTCIGWVRRAPGKEEELVAxICxxxGxTRYADSVKGRFTISADTSKNTAYLQMNSLRAEDTAVYYCAxxxxxx(x)(x)YxYWGQGTTVTVSS Phagemid template G44E_T45E_F(101-1)Y_P52aC_A71C_S31ab
EVQLVESGGGLVQPGGSLRLSCAASGFNIKDSSTYIGWVRRAPGKEEELVAxIxCxxGxTRYADSVKGRFTISCDTSKNTAYLQMNSLRAEDTAVYYCAxxxxxx(x)(x)YxYWGQGTTVTVSS Phagemid template G44E_T45E_F(101-1)Y_P52aC_A71C_G26S
EVQLVESGGGLVQPGGSLRLSCAASSFNIKDTYIGWVRRAPGKEEELVAxIxCxxGxTRYADSVKGRFTISCDTSKNTAYLQMNSLRAEDTAVYYCAxxxxxx(x)(x)YxYWGQGTTVTVSS

FIG. 7B

STABILIZED IMMUNOGLOBULIN DOMAINS

CROSS REFERENCE TO RELATED APPLICATIONS

This application is a continuation of International Application No. PCT/EP2019/052162 filed Jan. 30, 2019, claiming priority to European Application No. 18154316.6 filed Jan. 31, 2018, each of which is incorporated herein by reference in its entirety.

SEQUENCE LISTING

This application contains a Sequence Listing which has been submitted electronically in ASCII format and is hereby incorporated by reference in its entirety. Said ASCII copy, created on Nov. 5, 2020, is named P31949-US_SL.txt and is 721,604 bytes in size.

FIELD OF THE INVENTION

The present invention relates to engineered immunoglobulin domains, more specifically to engineered immunoglobulin heavy chain variable domains with improved stability, and libraries of such immunoglobulin domains. The invention further relates to methods for preparing such immunoglobulin domains, and to methods of using these immunoglobulin domains.

BACKGROUND

Single-domain antibody fragments can be derived from naturally occurring heavy-chain IgG of Camelidae species (termed VHHs) or IgNARs of cartilagous sharks (termed VNARs). While single-domain antibodies have several properties that make them interesting candidates for clinical development, non-human single-domain antibodies are unsuitable for therapeutic applications due to their immunogenicity in humans.

Single-domain antibody fragments derived from conventional human IgGs, however, are prone to aggregation due to their low stability and solubility (Ward et al., Nature 341, 544-546 (1989)), which limits their applications in therapy where protein stability is essential. Unstable proteins tend to partially unfold and aggregate, which eventually results in reduced therapeutic efficacy and undesired adverse effects.

Several approaches to improve the stability/solubility of single-domain and other recombinant antibody fragments have been undertaken. Selection-based approaches involve library selection of antibodies e.g. at elevated temperatures, extreme pH, or in the presence of proteases or denaturants. Engineering-based approaches include introduction of disulfide bonds and other stabilizing mutations into the antibody.

A method for obtaining single-domain antibodies with improved stability is selection from a library comprising a large number of single-domain antibody varieties. To generate such a library, one single-domain antibody is used as scaffold, which may be engineered to have improved stability. Progeny single-domain antibodies with the desired target-binding specificity can then be selected from the library by conventional panning, as they will largely inherit the improved properties of the parent scaffold. Another method for obtaining single-domain antibodies with improved stability is introduction of stabilizing mutations such as surface-exposed hydrophilic or charged amino acids into a previously-selected single domain antibody with desired binding properties.

Introduction of artificial disulfide bonds into proteins has been recognized as a strategy for increasing the conformational stability of proteins. However, instead of enhancing protein stability, disulfide bonds in inappropriate positions may have unfavorable effects on surrounding amino acids in the folded protein or interfere with an existing favorable interaction. While the selection of appropriate positions for disulfide cross-linking is essential, there are no established rules therefor.

Engineering of single-domain antibodies by introduction of an artificial non-canonical disulfide bond has been proposed as a strategy for improving their stability.

Heavy chain variable (VH) domains naturally comprise a highly conserved disulfide bond between cysteine residues 23 and 104 (IMGT numbering, corresponding to residues 22 and 92 according to the Kabat numbering system), which links the two β-strands B and F in the core of the VH and is crucial to their stability and function.

Introduction of a second, non-native disulfide linkage between positions 54 and 78 (IMGT numbering, corresponding to positions 49 and 69 according to the Kabat numbering system) into camelid VHHs (Saerens et al., J Mol Biol 377, 478-488 (2008), Chan et al., Biochemistry 47, 11041-11045 (2008), Hussack et al., Plos One 6, e28218 (2011)) or human VHs (Kim et al., Prot Eng Des Sel 25, 581-589 (2012), WO 2012/100343) was shown to lead to increases in their thermostability and (in the case of VHHs) protease resistance (Hussack et al., Plos One 6, e28218 (2011)). This particular disulfide linkage had previously been identified as naturally occurring in a unique dromedary VHH (Saerens et al., J Biol Chem 279, 51965-51972 (2004)). It links framework region 2 (FR2) and framework region 3 (FR3) in the VHH hydrophobic core.

While in principle effective, this approach does not come without some drawbacks, including reduced affinity, specificity and expression yield (Hussack et al., Plos One 6, e28218 (2011)).

Thus, there remains a need for stabilized single-domain antibodies, including autonomous VH domains.

SUMMARY OF THE INVENTION

The present invention is based on the finding that autonomous VH domains can be stabilized by the introduction of non-canonical cysteines, which are capable of forming disulfide bonds and/or form disulfide bridges under suitable conditions.

In a first aspect the invention provides, an autonomous VH domain comprises cysteines in positions (i) 52a and 71 or (ii) 33 and 52 according to Kabat numbering, wherein said cysteines are capable of forming a disulfide bond and/or form a disulfide bond under suitable conditions. Particularly, the autonomous VH domain is an isolated autonomous VH domain. The autonomous VH domain has improved stability.

In a preferred embodiment of the invention, the autonomous VH domain comprises a substitution selected from the group consisting of 44E, 45E, 45 R, (101-1)Y and 101D according to Kabat numbering. Particularly, the autonomous VH domain comprises the substitutions 44E, 45E or 45R, (101-1)Y and 101D according to Kabat numbering. In a further preferred embodiment, the autonomous VH domain comprises a substitution selected from the group consisting of G44E, T45E, T45 R, F(101-1)Y and A101D according to Kabat numbering. Particularly, the autonomous VH domain comprises the substitutions G44E, T45E, T45 R, F(101-1)Y and A101D according to Kabat numbering.

In a preferred embodiment of the invention, the autonomous VH domain comprises a substitution selected from the group consisting of 44E, 45E and (101-1)Y according to Kabat numbering. Particularly, the autonomous VH domain comprises the substitutions 44E, 45E, and (101-1)Y according to Kabat numbering. In a further preferred embodiment, the autonomous VH domain comprises a substitution selected from the group consisting of G44E, T45E and F(101-1)Y according to Kabat numbering, if present in the autonomous VH domain. Particularly, the autonomous VH domain comprises the substitutions G44E, T45E, and F(101-1)Y according to Kabat numbering. In a preferred embodiment of the invention, the autonomous VH domain comprises a heavy chain variable domain framework comprising a
(a) FR1 comprising at least 95% sequence identity to the amino acid sequence of SEQ ID NO: 207,
(b) FR2 comprising at least 95% sequence identity to the amino acid sequence of SEQ ID NO: 208,
(c) FR3 comprising at least 95% sequence identity to the amino acid sequence of SEQ ID NO: 209, and
(d) FR4 comprising at least 95% sequence identity to the amino acid sequence of SEQ ID NO: 210.

In another preferred embodiment of the invention, the autonomous VH domain comprises a heavy chain variable domain framework comprising a
(a) FR1 comprising at least 95% sequence identity to the amino acid sequence of SEQ ID NO: 211,
(b) FR2 comprising at least 95% sequence identity to the amino acid sequence of SEQ ID NO: 208,
(c) FR3 comprising at least 95% sequence identity to the amino acid sequence of SEQ ID NO: 209, and
(d) FR4 comprising at least 95% sequence identity to the amino acid sequence of SEQ ID NO: 210.

In a preferred embodiment of the invention, the autonomous VH domain comprises a heavy chain variable domain framework comprising a
(a) FR1 comprising the amino acid sequence of SEQ ID NO: 207,
(b) FR2 comprising the amino acid sequence of SEQ ID NO: 208,
(c) FR3 comprising the amino acid sequence of SEQ ID NO: 209, and
(d) FR4 comprising the amino acid sequence of SEQ ID NO: 210.

In another preferred embodiment of the invention, the autonomous VH domain comprises a heavy chain variable domain framework comprising a
(a) FR1 comprising the amino acid sequence of SEQ ID NO: 211,
(b) FR2 comprising the amino acid sequence of SEQ ID NO: 208,
(c) FR3 comprising the amino acid sequence of SEQ ID NO: 209, and
(d) FR4 comprising the amino acid sequence of SEQ ID NO: 210.

The autonomous VH domain is particularly useful, as FR1-4 according to SEQ ID NOs 207 to 211 are not immunogenic in humans. Thus, the autonomous VH domain of the invention is a promising candidate to generate VH libraries for the identification of antigen binding molecules.

In a preferred embodiment of the invention, the autonomous VH domain comprises the sequence of SEQ ID NO: 40, or SEQ ID NO: 42, or SEQ ID NO: 44, SEQ ID NO: 46, or SEQ ID NO: 180.

In a preferred embodiment of the invention, the autonomous VH domain comprises at least 95% sequence identity to the amino acid sequence of SEQ ID NO: 40, or SEQ ID NO: 42, or SEQ ID NO: 44, SEQ ID NO: 46, or SEQ ID NO: 180.

In a preferred embodiment of the invention, the autonomous VH domain binds to death receptor 5 (DR5), or melanoma-associated chondroitin sulfate proteoglycan (MCSP), or transferrin receptor 1 (TfR1), or lymphocyte-activation gene 3 (LAG3).

In a preferred embodiment of the invention, the autonomous VH domain binds to MCSP comprising
(i) CDR1 comprising the amino acid sequence of SEQ ID NO: 212, CDR2 comprising the amino acid sequence of SEQ ID NO: 213, and CDR3 comprising an amino acid sequence of SEQ ID NO: 214; or
(ii) CDR1 comprising the amino acid sequence of SEQ ID NO: 215, CDR2 comprising the amino acid sequence of SEQ ID NO: 216, and CDR3 comprising an amino acid sequence of SEQ ID NO: 217; or
(iII) CDR1 comprising the amino acid sequence of SEQ ID NO: 218, CDR2 comprising the amino acid sequence of SEQ ID NO: 219, and CDR3 comprising an amino acid sequence of SEQ ID NO: 220, or
(iv) CDR1 comprising the amino acid sequence of SEQ ID NO: 221, CDR2 comprising the amino acid sequence of SEQ ID NO: 222, and CDR3 comprising an amino acid sequence of SEQ ID NO: 223; or
(v) CDR1 comprising the amino acid sequence of SEQ ID NO: 224, CDR2 comprising the amino acid sequence of SEQ ID NO: 225, and CDR3 comprising an amino acid sequence of SEQ ID NO: 226.

In a preferred embodiment of the invention, the autonomous VH domain binds to TfR1 comprising
(i) CDR1 comprising the amino acid sequence of SEQ ID NO: 227, CDR2 comprising the amino acid sequence of SEQ ID NO: 228, and CDR3 comprising an amino acid sequence of SEQ ID NO: 229; or
(ii) CDR1 comprising the amino acid sequence of SEQ ID NO: 230, CDR2 comprising the amino acid sequence of SEQ ID NO: 231, and CDR3 comprising an amino acid sequence of SEQ ID NO: 232; or
(iii) CDR1 comprising the amino acid sequence of SEQ ID NO: 233, CDR2 comprising the amino acid sequence of SEQ ID NO: 234, and CDR3 comprising an amino acid sequence of SEQ ID NO: 235; or
(iv) CDR1 comprising the amino acid sequence of SEQ ID NO: 236, CDR2 comprising the amino acid sequence of SEQ ID NO: 237, and CDR3 comprising an amino acid sequence of SEQ ID NO: 238; or
(v) CDR1 comprising the amino acid sequence of SEQ ID NO: 239, CDR2 comprising the amino acid sequence of SEQ ID NO: 240, and CDR3 comprising an amino acid sequence of SEQ ID NO: 241; or
(vi) CDR1 comprising the amino acid sequence of SEQ ID NO: 242, CDR2 comprising the amino acid sequence of SEQ ID NO: 243, and CDR3 comprising an amino acid sequence of SEQ ID NO: 244; or
(vii) CDR1 comprising the amino acid sequence of SEQ ID NO: 245, CDR2 comprising the amino acid sequence of SEQ ID NO: 246, and CDR3 comprising an amino acid sequence of SEQ ID NO: 247.

The autonomous VH domain may bind to MCSP. The autonomous VH domain binding to MCSP may comprise an amino acid sequence selected from the group consisting of SEQ ID NO: 57, SEQ ID NO: 59, SEQ ID NO: 61, SEQ ID NO: 63, SEQ ID NO: 65. The autonomous VH domain may bind to TfR1. The autonomous VH domain binding to TfR1 may comprise an amino acid sequence selected from the group consisting of the amino acid sequence of SEQ ID NO: 194, the sequence of SEQ ID NO: 195, the amino acid sequence of SEQ ID NO: 196, the amino acid sequence of SEQ ID NO: 197, the amino acid sequence of SEQ ID NO: 198, the amino acid sequence of SEQ ID NO: 199, the amino acid sequence of SEQ ID NO: 200. The autonomous VH domain may bind to LAG3. The autonomous VH domain binding to Lag3 may comprise an amino acid sequence selected from the group consisting of SEQ ID NO: 77, SEQ ID NO: 79, SEQ ID NO: 81, SEQ ID NO: 83, SEQ ID NO: 85 SEQ, ID NO: 87, SEQ ID NO: 89, SEQ ID NO: 91, SEQ ID NO: 93, SEQ ID NO: 95, SEQ ID NO: 97.

In a preferred embodiment of the invention, the autonomous VH domain binds to LAG3 comprising (i) CDR1 comprising the amino acid sequence of SEQ ID NO: 146, CDR2 comprising the amino acid sequence of SEQ ID NO: 147, and CDR-H3 comprising an amino acid sequence of SEQ ID NO: 148; or (ii) CDR1 comprising the amino acid sequence of SEQ ID NO: 149, CDR2 comprising the amino acid sequence of SEQ ID NO: 150, and CDR3 comprising an amino acid sequence of SEQ ID NO: 151; or (iii) CDR1 comprising the amino acid sequence of SEQ ID NO: 152, CDR2 comprising the amino acid sequence of SEQ ID NO: 153, and CDR3 comprising an amino acid sequence of SEQ ID NO: 154; or (iv) CDR1 comprising the amino acid sequence of SEQ ID NO: 155, CDR2 comprising the amino acid sequence of SEQ ID NO: 156, and CDR3 comprising an amino acid sequence of SEQ ID NO: 157; or (v) CDR1 comprising the amino acid sequence of SEQ ID NO: 158, CDR2 comprising the amino acid sequence of SEQ ID NO: 159, and CDR3 comprising an amino acid sequence of SEQ ID NO: 160; or (vi) CDR1 comprising the amino acid sequence of SEQ ID NO: 161, CDR2 comprising the amino acid sequence of SEQ ID NO: 162, and CDR3 comprising an amino acid sequence of SEQ ID NO: 163; or (vii) CDR1 comprising the amino acid sequence of SEQ ID NO: 164, CDR2 comprising the amino acid sequence of SEQ ID NO: 165, and CDR3 comprising an amino acid sequence of SEQ ID NO: 166; or (viii) CDR1 comprising the amino acid sequence of SEQ ID NO: 167, CDR2 comprising the amino acid sequence of SEQ ID NO: 168, and CDR3 comprising an amino acid sequence of SEQ ID NO: 169; or (ix) CDR1 comprising the amino acid sequence of SEQ ID NO: 170, CDR2 comprising the amino acid sequence of SEQ ID NO: 171, and CDR3 comprising an amino acid sequence of SEQ ID NO: 172; or (x) CDR1 comprising the amino acid sequence of SEQ ID NO: 173, CDR2 comprising the amino acid sequence of SEQ ID NO: 174, and CDR3 comprising an amino acid sequence of SEQ ID NO: 175; or (xi) CDR1 comprising the amino acid sequence of SEQ ID NO: 176, CDR2 comprising the amino acid sequence of SEQ ID NO: 177, and CDR3 comprising an amino acid sequence of SEQ ID NO: 178.

In a preferred embodiment of the invention, the autonomous VH domain further comprises a substitution selected from the group consisting of H35G, Q39R, L45E and W47L.

In a preferred embodiment of the invention, the autonomous VH domain comprises a substitution selected from the group consisting of L45T, K94S and L108T.

In a preferred embodiment of the invention, the autonomous VH domain comprises a VH3_23 framework, particularly based on the VH sequence of Herceptin.

In a preferred embodiment of the invention, the autonomous VH domain is fused to an Fc domain.

In a preferred embodiment of the invention, the Fc domain is a human Fc domain.

In a preferred embodiment of the invention, the autonomous VH domain is fused to the N-terminal or to the C-terminal end of the end of the Fc domain. In a preferred embodiment of the invention, the Fc domain comprises a knob mutation or a hole mutation, particularly a knob mutation, relating to the "knob-into-hole-technology" as described herein. For both N- and C-terminal Fc fusions, a glycine-serine (GGGGSGGGGS (SEQ ID NO: 411)) linker, a linker with the linker sequence "DGGSPTPPTPGGGSA" (SEQ ID NO: 412) or any other linker may be preferably expressed between the autonomous VH domain and the Fc domain. Exemplary preferred fusions of an autonomous VH domain and an Fc domain comprise the amino acid sequence selected from the group consisting of SEQ ID NO: 121, SEQ ID NO: 123, SEQ ID NO: 125, SEQ ID NO: 127, SEQ ID NO: 129, SEQ ID NO: 131, SEQ ID NO: 133, SEQ ID NO: 135, SEQ ID NO: 137, SEQ ID NO: 139, SEQ ID NO: 141. Exemplary preferred fusions of an autonomous VH domain and an Fc domain comprise the amino acid sequence selected from the group consisting of SEQ ID NO: 99, SEQ ID NO: 101, SEQ ID NO: 103, SEQ ID NO: 105, SEQ ID NO: 107, SEQ ID NO: 109, SEQ ID NO: 111, SEQ ID NO: 113, SEQ ID NO: 115, SEQ ID NO: 117, SEQ ID NO: 119. A further aspect of the invention relates to a VH domain library comprising a variety of autonomous VH domains as disclosed herein.

A further aspect of the invention relates to a VH domain library comprising a plurality of autonomous VH domains as disclosed herein. A further aspect of the invention relates to a VH domain library comprising a plurality of autonomous VH domains as disclosed herein generated from a variety of polynucleotides.

A further aspect of the invention relates to a method of generating a VH domain library as disclosed herein.

A further aspect of the invention relates to a polynucleotide library comprising a plurality of polynucleotides encoding for a plurality of autonomous VH domains as disclosed herein.

A further aspect of the invention relates to a polynucleotide encoding an autonomous VH domain as disclosed herein.

A further aspect of the invention relates to an expression vector comprising the polynucleotide, wherein the polynucleotide encodes for an autonomous VH domain, as disclosed herein.

A further aspect of the invention relates to a host cell, particularly a eukaryotic or prokaryotic host cell, comprising the expression vector as disclosed herein.

A further aspect of the invention relates to an antibody, particularly a bispecific or multispecific antibody. The antibody, particularly the bispecific or multispecific antibody, comprises an autonomous VH domain as disclosed herein. Particularly, the antibody is an isolated antibody. In certain embodiments, the multispecific antibody has three or more binding specificities. In certain embodiments, bispecific antibodies may bind to two (or more) different epitopes of a target. Bispecific and multispecific antibodies can be prepared as full length antibodies or antibody fragments. Various molecular formats for multispecific antibodies are known in the art and are included herein (see e.g., Spiess et al., Mol Immunol 67 (2015) 95-106).

A further aspect of the invention relates to a method for identifying an antigen binding molecules using a VH domain library as disclosed herein. The method comprises the steps (i) contacting the VH domain library with a target, and (ii) identifying VH domains of the library binding the target. In step (ii) the VH domains of the library that bind to the target may be isolated for its identification.

A further aspect of the invention relates to a method for identifying an antigen binding molecules using a polynucleotide library as disclosed herein. The method comprises the steps (i) expressing the polynucleotide library, particularly in a host cell, (i) contacting the expressed VH domain library with a target, and (ii) identifying VH domains of the expressed VH domain library that bind to the target. In step (ii) the VH domains of the library that bind to the target may be isolated for its identification.

A further aspect of the invention relates to the use of a VH domain library as disclosed herein in a method as disclosed herein.

A further aspect of the invention relates to the use of a polynucleotide library as disclosed herein in a method as disclosed herein.

A further aspect of the invention relates to the use of an autonomous VH domain disclosed herein. A further aspect of the invention relates to the use of an autonomous VH domain identified by the use of a VH domain library as disclosed herein or by the use of a polynucleotide library as disclosed herein.

A further aspect of the invention relates to an autonomous VH domain that binds to FAP comprising the sequence of SEQ ID NO: 260. A further aspect of the invention relates to an autonomous VH domain that binds to FAP comprising the sequence of SEQ ID NO: 261. A further aspect of the invention relates to an autonomous VH domain that binds to FAP comprising the sequence of SEQ ID NO: 262. A further aspect of the invention relates to an autonomous VH domain that binds to FAP comprising the sequence of SEQ ID NO: 260. A further aspect of the invention relates to an autonomous VH domain that binds to FAP comprising the sequence of SEQ ID NO: 263. A further aspect of the invention relates to an autonomous VH domain that binds to FAP comprising the sequence of SEQ ID NO: 264. A further aspect of the invention relates to an autonomous VH domain that binds to FAP comprising the sequence of SEQ ID NO: 265. A further aspect of the invention relates to an autonomous VH domain that binds to FAP comprising the sequence of SEQ ID NO: 266. A further aspect of the invention relates to an autonomous VH domain that binds to FAP comprising the sequence of SEQ ID NO: 267. A further aspect of the invention relates to an autonomous VH domain that binds to FAP comprising the sequence of SEQ ID NO: 268. A further aspect of the invention relates to an autonomous VH domain that binds to FAP comprising the sequence of SEQ ID NO: 269. A further aspect of the invention relates to an autonomous VH domain that binds to FAP comprising the sequence of SEQ ID NO: 270. A further aspect of the invention relates to an autonomous VH domain that binds to FAP comprising the sequence of SEQ ID NO: 271. A further aspect of the invention relates to an autonomous VH domain that binds to FAP comprising the sequence of SEQ ID NO: 272. A further aspect of the invention relates to an autonomous VH domain that binds to FAP comprising the sequence of SEQ ID NO: 273. A further aspect of the invention relates to an autonomous VH domain that binds to FAP comprising the sequence of SEQ ID NO: 274. A further aspect of the invention relates to an autonomous VH domain that binds to FAP comprising the sequence of SEQ ID NO: 275. A further aspect of the invention relates to an autonomous VH domain that binds to FAP comprising the sequence of SEQ ID NO: 276. A further aspect of the invention relates to an autonomous VH domain that binds to FAP comprising the sequence of SEQ ID NO: 277. A further aspect of the invention relates to an autonomous VH domain that binds to FAP comprising the sequence of SEQ ID NO: 278. A further aspect of the invention relates to an autonomous VH domain that binds to FAP comprising the sequence of SEQ ID NO: 279.

A further aspect of the invention relates to an autonomous VH domain that binds to CEA comprising the sequence of SEQ ID NO: 300. A further aspect of the invention relates to an autonomous VH domain that binds to CEA comprising the sequence of SEQ ID NO: 301. A further aspect of the invention relates to an autonomous VH domain that binds to CEA comprising the sequence of SEQ ID NO: 302. A further aspect of the invention relates to an autonomous VH domain that binds to CEA comprising the sequence of SEQ ID NO: 303. A further aspect of the invention relates to an autonomous VH domain that binds to CEA comprising the sequence of SEQ ID NO: 304. A further aspect of the invention relates to an autonomous VH domain that binds to CEA comprising the sequence of SEQ ID NO: 305. A further aspect of the invention relates to an autonomous VH domain that binds to CEA comprising the sequence of SEQ ID NO: 306. A further aspect of the invention relates to an autonomous VH domain that binds to CEA comprising the sequence of SEQ ID NO: 307. A further aspect of the invention relates to an autonomous VH domain that binds to CEA comprising the sequence of SEQ ID NO: 308. A further aspect of the invention relates to an autonomous VH domain that binds to CEA comprising the sequence of SEQ ID NO: 309. A further aspect of the invention relates to an autonomous VH domain that binds to CEA comprising the sequence of SEQ ID NO: 310. A further aspect of the invention relates to an autonomous VH domain that binds to CEA comprising the sequence of SEQ ID NO: 311. A further aspect of the invention relates to an autonomous VH domain that binds to CEA comprising the sequence of SEQ ID NO: 312. A further aspect of the invention relates to an autonomous VH domain that binds to CEA comprising the sequence of SEQ ID NO: 313.

A further aspect of the invention relates to an autonomous VH domain that binds to CD28 comprising the sequence of SEQ ID NO: 328. A further aspect of the invention relates to an autonomous VH domain that binds to CD28 comprising the sequence of SEQ ID NO: 329. A further aspect of the invention relates to an autonomous VH domain that binds to CD28 comprising the sequence of SEQ ID NO: 330. A further aspect of the invention relates to an autonomous VH domain that binds to CD28 comprising the sequence of SEQ ID NO: 331. A further aspect of the invention relates to an autonomous VH domain that binds to CD28 comprising the sequence of SEQ ID NO: 332. A further aspect of the invention relates to an autonomous VH domain that binds to CD28 comprising the sequence of SEQ ID NO: 333. A further aspect of the invention relates to an autonomous VH domain that binds to CD28 comprising the sequence of SEQ ID NO: 334. A further aspect of the invention relates to an autonomous VH domain that binds to CD28 comprising the sequence of SEQ ID NO: 335. A further aspect of the invention relates to an autonomous VH domain that binds to CD28 comprising the sequence of SEQ ID NO: 336. A further aspect of the invention relates to an autonomous VH domain that binds to CD28 comprising the sequence of SEQ ID NO: 337. A further aspect of the invention relates to an autonomous VH domain that binds to CD28 comprising the sequence of SEQ ID NO: 338. A further aspect of the invention relates to an autonomous VH domain that binds to CD28 comprising the sequence of SEQ ID NO: 339. A further aspect of the invention relates to an autonomous VH domain that binds to CD28 comprising the sequence of SEQ ID NO: 340. A further aspect of the invention relates to an autonomous VH domain that binds to CD28 comprising the sequence of SEQ ID NO: 341. A further aspect of the invention relates to an autonomous VH domain that binds to CD28 comprising the sequence of SEQ ID NO: 342. A further aspect of the invention relates to an autonomous VH domain that binds to CD28 comprising the sequence of SEQ ID NO: 343. A further aspect of the invention relates to an autonomous VH domain that binds to CD28 comprising the sequence of SEQ ID NO: 344. A further aspect of the invention relates to an autonomous VH domain that binds to CD28 comprising the sequence of SEQ ID NO: 345. A further aspect of the invention relates to an autonomous VH domain that binds to CD28 comprising the sequence of SEQ ID NO: 346.

A further aspect of the invention relates to an autonomous VH domain comprising the sequence of SEQ ID NO: 375. A further aspect of the invention relates to an autonomous VH domain comprising the sequence of SEQ ID NO: 376. A further aspect of the invention relates to an autonomous VH domain comprising the sequence of SEQ ID NO: 377. A further aspect of the invention relates to an autonomous VH domain comprising the sequence of SEQ ID NO: 378. A further aspect of the invention relates to an autonomous VH domain comprising the sequence of SEQ ID NO: 379. A further aspect of the invention relates to an autonomous VH domain comprising the sequence of SEQ ID NO: 380. A further aspect of the invention relates to an autonomous VH domain comprising the sequence of SEQ ID NO: 381. A further aspect of the invention relates to an autonomous VH domain comprising the sequence of SEQ ID NO: 382. A further aspect of the invention relates to an autonomous VH domain comprising the sequence of SEQ ID NO: 383. A further aspect of the invention relates to an autonomous VH domain comprising the sequence of SEQ ID NO: 384. A further aspect of the invention relates to an autonomous VH domain comprising the sequence of SEQ ID NO: 385. A further aspect of the invention relates to an autonomous VH domain comprising the sequence of SEQ ID NO: 386. A further aspect of the invention relates to an autonomous VH domain comprising the sequence of SEQ ID NO: 387. A further aspect of the invention relates to an autonomous VH domain comprising the sequence of SEQ ID NO: 388. A further aspect of the invention relates to an autonomous VH domain comprising the sequence of SEQ ID NO: 389. A further aspect of the invention relates to an autonomous VH domain comprising the sequence of SEQ ID NO: 390. A further aspect of the invention relates to an autonomous VH domain comprising the sequence of SEQ ID NO: 391. A further aspect of the invention relates to an autonomous VH domain comprising the sequence of SEQ ID NO: 392. A further aspect of the invention relates to an autonomous VH domain comprising the sequence of SEQ ID NO: 393. A further aspect of the invention relates to an autonomous VH domain comprising the sequence of SEQ ID NO: 394. A further aspect of the invention relates to an autonomous VH domain comprising the sequence of SEQ ID NO: 395. A further aspect of the invention relates to an autonomous VH domain comprising the sequence of SEQ ID NO: 396. A further aspect of the invention relates to an autonomous VH domain comprising the sequence of SEQ ID NO: 397. A further aspect of the invention relates to an autonomous VH domain comprising the sequence of SEQ ID NO: 398. A further aspect of the invention relates to an autonomous VH domain comprising the sequence of SEQ ID NO: 399. A further aspect of the invention relates to an autonomous VH domain comprising the sequence of SEQ ID NO: 400.

BRIEF DESCRIPTION OF THE FIGURES

FIG. 1A-B: Sequence and randomization strategy of a new aVH library. FIG. 1A: Sequence alignment of the Herceptin heavy chain (SEQ ID NO: 419) and the modified sequence (Barthelemy et al., J. Biol. Chem. 2008, 283:3639-3654) that allows expression of a monomeric and stable autonomous human heavy chain variable domain. FIG. 1B: Randomization strategy of the CDR3 region in the first aVH library. Shown are parts of the framework 3 region, the CDR3 region (boxed) with the 3 different CDR3 sequence lengths according to the numbering of Kabat, and the framework 4 region. Letters in bold indicate a different sequence compared to sequence B1ab, (X) represent the randomized positions. FIG. 1B discloses SEQ ID NOS 420-422, respectively, in order of appearance.

FIG. 2A: On DNA level, the nucleotide sequence encoding for the aVH domain was fused to a DNA sequence encoding for a two-fold GGGGS linker (SEQ ID NO: 413) or for the linker sequence DGGSPTPPTPGGGSA (SEQ ID NO: 412), which was fused to the DNA sequence encoding for an Fc domain encoding sequence. In the final protein construct, the aVH domain is fused via one of the aforementioned linkers to the N-terminal end of a human-derived IgG1 Fc sequence, here an Fc-knob fragment, which is co-expressed with a sequence encoding an Fc-hole fragment resulting in a monomeric display per Fc dimer. Both the Fc-knob and the Fc-hole could also contain the PG-LALA mutations. FIG. 2B: The nucleotide sequence encoding the VH domain of an IgG antibody was replaced by the nucleotide sequence encoding for the aVH domain. In addition, the sequence encoding the variable domain of a kappa light chain was deleted resulting in the expression of the sole kappa domain. Co-expression leads to an IgG-like construct with bivalent aVH display. FIG. 2C: On DNA level, the nucleotide sequence encoding for the aVH domain was fused to a DNA sequence encoding for a two-fold GGGGS linker (SEQ ID NO: 413), which was fused to the DNA sequence encoding for an Fc domain encoding sequence. In the final protein construct, the aVH domain is fused via the aforementioned linker to the N-terminal end of a human-derived IgG1 Fc sequence, here either a wild-type Fc domain or an Fc domain that harbors the PG-LALA mutations. Expression leads to an IgG-like construct with bivalent aVH display.

FIG. 3A-B: Sequence alignment of the disulfide-stabilized aVHs and the designed templates for the new libraries. FIG. 3A: An alignment of aVH library templates is shown based on the P52aC/A71C combination. FIG. 3B: An alignment of the aVH library template is shown based on the Y33C/Y52C combination.

FIG. 6: Alignment of the parental 6H1 sequence and its stabilizing mutations for the improvement of the biochemical properties. Shown is the sequence of clone 6H1 and the variants that contain single point mutations or a combination thereof at the previously identified positions. FIG. 6 discloses SEQ ID NOS 423-438, respectively, in order of appearance.

FIG. 7A-B: New library templates containing mutations for the generation of new aVHs clones with improved biochemical properties. FIG. 7A: Sequences of the 3 new library templates that contain the identified mutations G44E, T45E, and F (101-1) Y. FIG. 7A discloses SEQ ID NOS 258, 257, and 256, respectively, in order of appearance. FIG. 7B: Randomization strategy of the CDR2 and 3 regions in the 3 new aVH libraries. Positions marked with "X" represent the randomized positions in the new templates. Positions in brackets (X) indicate the 3 different lengths of the CDR3 regions in the newly generated libraries, FIG. 7B discloses SEQ ID NOS 439-441, respectively, in order of appearance.

DETAILED DESCRIPTION OF EMBODIMENTS OF THE INVENTION

I. Definitions

Figures 2A, 2B, 2C:
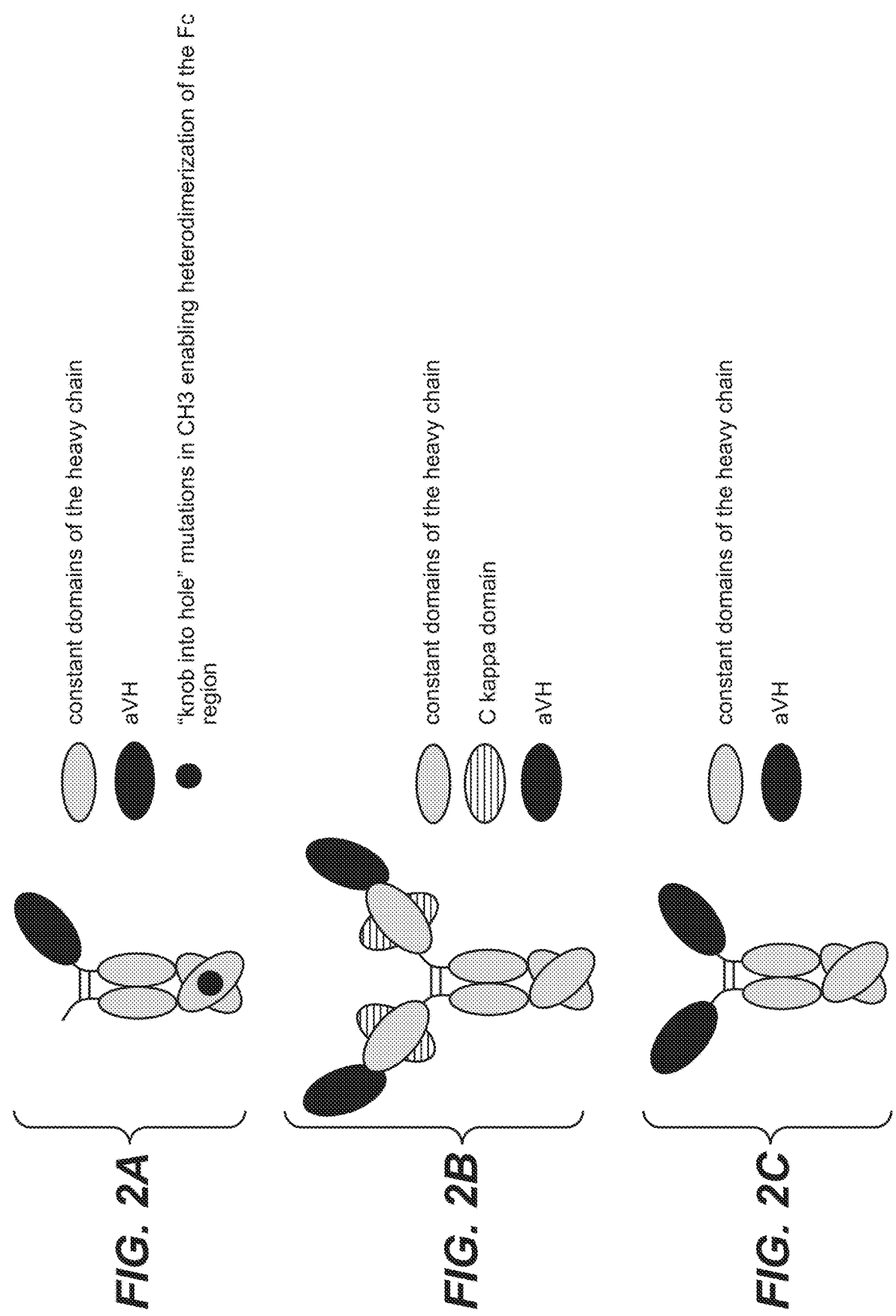
FIG. 2A-C: Schematic diagram of the generated Fc-based aVH constructs.

Unless defined otherwise, technical and scientific terms used herein have the same meaning as generally used in the art to which this invention belongs. For purposes of interpreting this specification, the following definitions will apply and whenever appropriate, terms used in the singular will also include the plural and vice versa.

As used herein, the term "antigen binding molecule" refers in its broadest sense to a molecule that specifically binds an antigenic determinant. Examples of antigen binding molecules are antibodies, antibody fragments and scaffold antigen binding proteins.

The term "antibody" herein is used in the broadest sense and encompasses various antibody structures, including but not limited to monoclonal antibodies, polyclonal antibodies, monospecific and multispecific antibodies (e.g., bispecific antibodies), and antibody fragments so long as they exhibit the desired antigen-binding activity.

The term "monospecific" antibody as used herein denotes an antibody that has one or more binding sites each of which bind to the same epitope of the same antigen. The term "bispecific" means that the antibody is able to specifically bind to two distinct antigenic determinants, for example by two binding sites each formed by a pair of an antibody heavy chain variable domain (VH) and an antibody light chain variable domain (VL) or by a pair of autonomous VH domains binding to different antigens or to different epitopes on the same antigen. Such a bispecific antibody is e.g. a 1+1 format. Other bispecific antibody formats are 2+1 formats (comprising two binding sites for a first antigen or epitope and one binding site for a second antigen or epitope) or 2+2 formats (comprising two binding sites for a first antigen or epitope and two binding sites for a second antigen or epitope). Typically, a bispecific antibody comprises two antigen binding sites, each of which is specific for a different antigenic determinant. The term "multispecific" antibody as used herein refers to an antibody that has three or more binding sites binding to different antigens or to different epitopes on the same antigen. In certain embodiments, multispecific antibodies are monoclonal antibodies that have binding specificities for at least three different sites, i.e., different epitopes on different antigens or different epitopes on the same antigen. Multispecific antibodies may also be used to localize cytotoxic agents or cells to cells which express a target.

The term "valent" as used within the current application denotes the presence of a specified number of binding sites in an antigen binding molecule. As such, the terms "bivalent", "tetravalent", and "hexavalent" denote the presence of two binding sites, four binding sites, and six binding sites, respectively, in an antigen binding molecule. The bispecific antibodies according to the invention are at least "bivalent" and may be "trivalent" or "multivalent" (e.g. "tetravalent" or "hexavalent"). In a particular aspect, the antibodies of the present invention have two or more binding sites and are bispecific or multispecific. That is, the antibodies may be bispecific in cases where there are two binding sites even in cases where there are more than two binding sites (i.e. that the antibody is trivalent or multivalent).

The terms "full length antibody", "intact antibody", and "whole antibody" are used herein interchangeably to refer to an antibody having a structure substantially similar to a native antibody structure. "Native antibodies" refer to naturally occurring immunoglobulin molecules with varying structures. For example, native IgG-class antibodies are heterotetrameric glycoproteins of about 150,000 daltons, composed of two light chains and two heavy chains that are disulfide-bonded. From N- to C-terminus, each heavy chain has a variable region (VH), also called a variable heavy domain or a heavy chain variable domain, followed by three constant domains (CH1, CH2, and CH3), also called a heavy chain constant region. Similarly, from N- to C-terminus, each light chain has a variable region (VL), also called a variable light domain or a light chain variable domain, followed by a light chain constant domain (CL), also called a light chain constant region. The heavy chain of an antibody may be assigned to one of five types, called α (IgA), δ (IgD), ε (IgE), γ (IgG), or μ, (IgM), some of which may be further divided into subtypes, e.g. γ1 (IgG1), γ2 (IgG2), γ3 (IgG3), γ4 (IgG4), α1 (IgA1) and α2 (IgA2). The light chain of an antibody may be assigned to one of two types, called kappa (κ) and lambda (λ), based on the amino acid sequence of its constant domain.

An "antibody fragment" refers to a molecule other than an intact antibody that comprises a portion of an intact antibody that binds the antigen to which the intact antibody binds. Examples of antibody fragments include but are not limited to Fv, Fab, Fab', Fab'-SH, F(ab')2; diabodies, triabodies, tetrabodies, cross-Fab fragments; linear antibodies; single-chain antibody molecules (e.g. scFv); multispecific antibodies formed from antibody fragments and single domain antibodies. For a review of certain antibody fragments, see Hudson et al., Nat Med 9, 129-134 (2003). For a review of scFv fragments, see e.g. Plückthun, in The Pharmacology of Monoclonal Antibodies, vol. 113, Rosenburg and Moore eds., Springer-Verlag, New York, pp. 269-315 (1994); see also WO 93/16185; and U.S. Pat. Nos. 5,571,894 and 5,587,458. For discussion of Fab and F(ab')2 fragments comprising salvage receptor binding epitope residues and having increased in vivo half-life, see U.S. Pat. No. 5,869, 046. Diabodies are antibody fragments with two antigen-binding sites that may be bivalent or bispecific, see, for example, EP 404,097; WO 1993/01161; Hudson et al., Nat Med 9, 129-134 (2003); and Hollinger et al., ProcNatl Acad Sci USA 90, 6444-6448 (1993). Triabodies and tetrabodies are also described in Hudson et al., Nat Med 9, 129-134 (2003).

Single-domain antibodies are antibody fragments comprising all or a portion of the heavy chain variable domain or all or a portion of the light chain variable domain of an antibody or an autonomous VH domain. In certain embodiments, a single-domain antibody is a human single-domain antibody (Domantis, Inc., Waltham, MA; see e.g. U.S. Pat. No. 6,248,516 B1). Antibody fragments can be made by various techniques, including but not limited to proteolytic digestion of an intact antibody as well as production by host cells (e.g. *E. coli*), as described herein.

Classically, papain digestion of intact antibodies produces two identical antigen-binding fragments, called "Fab" fragments containing each the heavy- and light-chain variable domains and also the constant domain of the light chain and the first constant domain (CH1) of the heavy chain. As used herein, Thus, the term "Fab fragment" refers to an antibody fragment comprising a light chain fragment comprising a VL domain and a constant domain of a light chain (CL), and a VH domain and a first constant domain (CH1) of a heavy chain. Fab' fragments differ from Fab fragments by the addition of a few residues at the carboxy terminus of the heavy chain CH1 domain including one or more cysteines from the antibody hinge region. Fab'-SH are Fab' fragments wherein the cysteine residue(s) of the constant domains bear a free thiol group. Pepsin treatment yields an F(ab')2 fragment that has two antigen-combining sites (two Fab fragments) and a part of the Fc region.

The term "cross-Fab fragment" or "xFab fragment" or "crossover Fab fragment" refers to a Fab fragment, wherein either the variable regions or the constant regions of the heavy and light chain are exchanged. A cross-Fab fragment comprises a polypeptide chain composed of the light chain variable region (VL) and the heavy chain constant region 1 (CH1), and a polypeptide chain composed of the heavy chain variable region (VH) and the light chain constant region (CL). Asymmetrical Fab arms can also be engineered by introducing charged or non-charged amino acid mutations into domain interfaces to direct correct Fab pairing. See e.g., WO 2016/172485.

A "single chain Fab fragment" or "scFab" is a polypeptide consisting of an antibody heavy chain variable domain (VH), an antibody constant domain 1 (CH1), an antibody light chain variable domain (VL), an antibody light chain constant domain (CL) and a linker, wherein said antibody domains and said linker have one of the following orders in N-terminal to C-terminal direction: a) VH-CH1-linker-VL-CL, b) VL-CL-linker-VH-CH1, c) VH-CL-linker-VL-CH1 or d) VL-CH1-linker-VH-CL; and wherein said linker is a polypeptide of at least 30 amino acids, preferably between 32 and 50 amino acids. Said single chain Fab fragments are stabilized via the natural disulfide bond between the CL domain and the CH1 domain. In addition, these single chain Fab molecules might be further stabilized by generation of interchain disulfide bonds via insertion of cysteine residues (e.g. position 44 in the variable heavy chain and position 100 in the variable light chain according to Kabat numbering).

A "crossover single chain Fab fragment" or "x-scFab" is a is a polypeptide consisting of an antibody heavy chain variable domain (VH), an antibody constant domain 1 (CH1), an antibody light chain variable domain (VL), an antibody light chain constant domain (CL) and a linker, wherein said antibody domains and said linker have one of the following orders in N-terminal to C-terminal direction: a) VH-CL-linker-VL-CH1 and b) VL-CH1-linker-VH-CL; wherein VH and VL form together an antigen-binding site which binds specifically to an antigen and wherein said linker is a polypeptide of at least 30 amino acids. In addition, these x-scFab molecules might be further stabilized by generation of interchain disulfide bonds via insertion of cysteine residues (e.g. position 44 in the variable heavy chain and position 100 in the variable light chain according to Kabat numbering).

A "single-chain variable fragment (scFv)" is a fusion protein of the variable regions of the heavy (VH) and light chains (VL) of an antibody, connected with a short linker peptide of ten to about 25 amino acids. The linker is usually rich in glycine for flexibility, as well as serine or threonine for solubility, and can either connect the N-terminus of the VH with the C-terminus of the VL, or vice versa. This protein retains the specificity of the original antibody, despite removal of the constant regions and the introduction of the linker. scFv antibodies are, e.g. described in Houston, J. S., Methods in Enzymol. 203 (1991) 46-96).

A "single-domain antibody" is an antibody fragment consisting of a single monomeric variable antibody domain. The first single domains were derived from the variable domain of the antibody heavy chain from camelids (nanobodies or VHH fragments). Furthermore, the term single-domain antibody includes an autonomous heavy chain variable domain (aVH) or VNAR fragments derived from sharks.

The term "epitope" denotes the site on an antigen, either proteinaceous or non-proteinaceous, to which an antibody binds. Epitopes can be formed both from contiguous amino acid stretches (linear epitope) or comprise non-contiguous amino acids (conformational epitope), e.g. coming in spatial proximity due to the folding of the antigen, i.e. by the tertiary folding of a proteinaceous antigen. Linear epitopes are typically still bound by an antibody after exposure of the proteinaceous antigen to denaturing agents, whereas conformational epitopes are typically destroyed upon treatment with denaturing agents. An epitope comprises at least 3, at least 4, at least 5, at least 6, at least 7, or 8-10 amino acids in a unique spatial conformation.

Screening for antibodies binding to a particular epitope (i.e., those binding to the same epitope) can be done using methods routine in the art such as, e.g., without limitation, alanine scanning, peptide blots (see Meth. Mol. Biol. 248 (2004) 443-463), peptide cleavage analysis, epitope excision, epitope extraction, chemical modification of antigens (see Prot. Sci. 9 (2000) 487-496), and cross-blocking (see "Antibodies", Harlow and Lane (Cold Spring Harbor Press, Cold Spring Harb., NY).

Antigen Structure-based Antibody Profiling (ASAP), also known as Modification-Assisted Profiling (MAP), allows to bin a multitude of monoclonal antibodies specifically binding to a target based on the binding profile of each of the antibodies from the multitude to chemically or enzymatically modified antigen surfaces (see, e.g., US 2004/0101920). The antibodies in each bin bind to the same epitope which may be a unique epitope either distinctly different from or partially overlapping with epitope represented by another bin.

Also competitive binding can be used to easily determine whether an antibody binds to the same epitope of a target as, or competes for binding with, a reference antibody. For example, an "antibody that binds to the same epitope" as a reference antibody refers to an antibody that blocks binding of the reference antibody to its antigen in a competition assay by 50% or more, and conversely, the reference antibody blocks binding of the antibody to its antigen in a competition assay by 50% or more. Also for example, to determine if an antibody binds to the same epitope as a reference, the reference antibody is allowed to bind to the target under saturating conditions. After removal of the excess of the reference antibody, the ability of an antibody in question to bind to the target is assessed. If the antibody is able to bind to the target after saturation binding of the reference antibody, it can be concluded that the antibody in question binds to a different epitope than the reference antibody. But, if the antibody in question is not able to bind to the target after saturation binding of the reference antibody, then the antibody in question may bind to the same epitope as the epitope bound by the reference antibody. To confirm whether the antibody in question binds to the same epitope or is just hampered from binding by steric reasons routine experimentation can be used (e.g., peptide mutation and binding analyses using ELISA, RIA, surface plasmon resonance, flow cytometry or any other quantitative or qualitative antibody-binding assay available in the art). This assay should be carried out in two set-ups, i.e. with both of the antibodies being the saturating antibody. If, in both set-ups, only the first (saturating) antibody is capable of binding to the target, then it can be concluded that the antibody in question and the reference antibody compete for binding to the target.

In some embodiments two antibodies are deemed to bind to the same or an overlapping epitope if a 1-, 5-, 10-, 20- or 100-fold excess of one antibody inhibits binding of the other by at least 50%, at least 75%, at least 90% or even 99% or more as measured in a competitive binding assay (see, e.g., Junghans et al., Cancer Res. 50 (1990) 1495-1502).

In some embodiments two antibodies are deemed to bind to the same epitope if essentially all amino acid mutations in the antigen that reduce or eliminate binding of one antibody also reduce or eliminate binding of the other. Two antibodies are deemed to have "overlapping epitopes" if only a subset of the amino acid mutations that reduce or eliminate binding of one antibody reduce or eliminate binding of the other.

As used herein, the term "antigen-binding site" or "antigen-binding domain" refers to the part of the antigen binding molecule that specifically binds to an antigenic determinant. More particularly, the term "antigen-binding site" refers the part of an antibody that comprises the area which specifically binds to and is complementary to part or all of an antigen. Where an antigen is large, an antigen binding molecule may only bind to a particular part of the antigen, which part is termed an epitope. An antigen-binding site may be provided by, for example, one or more variable domains (also called variable regions). Preferably, an antigen-binding site comprises an autonomous VH domain. In one aspect, the antigen-binding site is able to bind to its antigen and block or partly block its function. Antigen binding sites that specifically bind to MCSP, TfR1, LAG3 or others include antibodies and fragments thereof as further defined herein. In addition, antigen-binding sites may include scaffold antigen binding proteins, e.g. binding domains which are based on designed repeat proteins or designed repeat domains (see e.g. WO 2002/020565).

By "specific binding" is meant that the binding is selective for the antigen and can be discriminated from unwanted or non-specific interactions. An antibody is said to "specifically bind" to a target, for example DR5, MCSP, TfR1 or Lag3, when the antibody has a $K_d$ of 1 µM or less. The ability of an antigen binding molecule to bind to a specific antigen can be measured either through an enzyme-linked immunosorbent assay (ELISA) or other techniques familiar to one of skill in the art, e.g. Surface Plasmon Resonance (SPR) technique (analyzed on a BIAcore instrument) (Liljeblad et al., Glyco 15 J 17, 323-329 (2000)), and traditional binding assays (Heeley, Endocr Res 28, 217-229 (2002)). In one embodiment, the extent of binding of an antigen binding molecule to an unrelated protein is less than about 10% of the binding of the antigen binding molecule to the antigen as measured, e.g. by SPR. In certain embodiments, an molecule that binds to the antigen has a dissociation constant ($K_d$) of ≤1 µM, ≤100 nM, ≤10 nM, ≤1 nM, ≤0.1 nM, ≤0.01 nM, or ≤0.001 nM (e.g. $10^{-7}$ M or less, e.g. from $10^{-7}$ M to $10^{-13}$ M, e.g. from $10^{-9}$ M to $10^{-13}$ M).

"Affinity" or "binding affinity" refers to the strength of the sum total of non-covalent interactions between a single binding site of a molecule (e.g. an antibody) and its binding partner (e.g. an antigen). Unless indicated otherwise, as used herein, "binding affinity" refers to intrinsic binding affinity which reflects a 1:1 interaction between members of a binding pair (e.g. antibody and antigen). The affinity of a molecule X for its partner Y can generally be represented by the dissociation constant ($K_d$), which is the ratio of dissociation and association rate constants ($k_{off}$ and $k_{on}$, respectively). Thus, equivalent affinities may comprise different rate constants, as long as the ratio of the rate constants remains the same. Affinity can be measured by common methods known in the art, including those described herein. A particular method for measuring affinity is Surface Plasmon Resonance (SPR).

As used herein, the term "high affinity" of an antibody refers to an antibody having a $K_d$ of $10^{-9}$ M or less and even more particularly $10^{-10}$ M or less for a target antigen. The term "low affinity" of an antibody refers to an antibody having a $K_d$ of $10^{-8}$ or higher.

An "affinity matured" antibody refers to an antibody with one or more alterations in one or more hypervariable regions (HVRs), compared to a parent antibody which does not possess such alterations, such alterations resulting in an improvement in the affinity of the antibody for antigen.

A "blocking" antibody or an "antagonist" antibody is one that inhibits or reduces a biological activity of the antigen it binds. In some embodiments, blocking antibodies or antagonist antibodies substantially or completely inhibit the biological activity of the antigen.

The term "variable region" or "variable domain" refers to the domain of an antibody heavy or light chain that is involved in binding the antigen binding molecule to antigen. The variable domains of the heavy chain and light chain (VH and VL, respectively) of a native antibody generally have similar structures, with each domain comprising four conserved framework regions (FRs) and three hypervariable regions (HVRs). See, e.g., Kindt et al., Kuby Immunology, 6th ed., W.H. Freeman and Co., page 91 (2007). A single VH or VL domain may be sufficient to confer antigen-binding specificity.

The term "hypervariable region" or "HVR" as used herein refers to each of the regions of an antibody variable domain which are hypervariable in sequence ("complementarity determining regions" or "CDRs") and/or form structurally defined loops ("hypervariable loops") and/or contain the antigen-contacting residues ("antigen contacts"). Generally, antibodies comprise six HVRs: three in the VH (H1, H2, H3), and three in the VL (L1, L2, L3). Exemplary HVRs herein include:
  (a) hypervariable loops occurring at amino acid residues 26-32 (L1), 50-52 (L2), 91-96 (L3), 26-32 (H1), 53-55 (H2), and 96-101 (H3) (Chothia and Lesk, J. Mol. Biol. 196:901-917 (1987));
  (b) CDRs occurring at amino acid residues 24-34 (L1), 50-56 (L2), 89-97 (L3), 31-35b (H1), 50-65 (H2), and 95-102 (H3) (Kabat et al., Sequences of Proteins of Immunological Interest, 5th Ed. Public Health Service, National Institutes of Health, Bethesda, MD (1991));
  (c) antigen contacts occurring at amino acid residues 27c-36 (L1), 46-55 (L2), 89-96 (L3), 30-35b (H1), 47-58 (H2), and 93-101 (H3) (MacCallum et al. J. Mol. Biol. 262: 732-745 (1996)); and
  (d) combinations of (a), (b), and/or (c), including HVR amino acid residues 46-56 (L2), 47-56 (L2), 48-56 (L2), 49-56 (L2), 26-35 (H1), 26-35b (H1), 49-65 (H2), 93-102 (H3), and 94-102 (H3).

Unless otherwise indicated, HVR (e.g. CDR) residues and other residues in the variable domain (e.g., FR residues) are numbered herein according to Kabat et al., supra. Kabat et al. also defined a numbering system for variable region sequences that is applicable to any antibody. One of ordinary skill in the art can unambiguously assign this system of "Kabat numbering" to any variable region sequence, without reliance on any experimental data beyond the sequence itself. As used herein, "Kabat numbering" refers to the numbering system set forth by Kabat et al., U.S. Dept. of Health and Human Services, "Sequence of Proteins of Immunological Interest" (1983). Unless otherwise specified herein, numbering of amino acid residues in the Fc region or constant region is according to the EU numbering system, also called the EU index, as described in Kabat et al., Sequences of Proteins of Immunological Interest, 5th Ed. Public Health Service, National Institutes of Health, Bethesda, MD, 1991.

With the exception of CDR1 in VH, CDRs generally comprise the amino acid residues that form the hypervariable loops. CDRs also comprise "specificity determining residues," or "SDRs," which are residues that contact antigen. SDRs are contained within regions of the CDRs called abbreviated-CDRs, or a-CDRs. Exemplary a-CDRs (a-CDR-L1, a-CDR-L2, a-CDR-L3, a-CDR-H1, a-CDR-H2, and a-CDR-H3) occur at amino acid residues 31-34 of L1, 50-55 of L2, 89-96 of L3, 31-35B of H1, 50-58 of H2, and 95-102 of H3. (See Almagro and Fransson, Front. Biosci. 13:1619-1633 (2008).) For simplicity, in the context of autonomous VH domains it is referred herein to CDR1, CDR2 and CDR3, because no second polypeptide chain, e.g. a VL domain, is present in an autonomous VH domain.

"Framework" or "FR" refers to variable domain residues other than hypervariable region (HVR) residues. The FR of a variable domain generally consists of four FR domains: FR1, FR2, FR3, and FR4. Accordingly, the HVR and FR sequences generally appear in the following sequence in VH (or VL): FR1-H1(L1)-FR2-H2(L2)-FR3-H3(L3)-FR4. For simplicity, in the context of autonomous VH domains it is referred herein to FR1, FR2, FR3 and FR4, as autonomous VH domains are not composed of two chains, particularly by a VH domain and VL domain.

An "acceptor human framework" for the purposes herein is a framework comprising the amino acid sequence of a light chain variable domain (VL) framework or a heavy chain variable domain (VH) framework derived from a human immunoglobulin framework or a human consensus framework. An acceptor human framework "derived from" a human immunoglobulin framework or a human consensus framework may comprise the same amino acid sequence thereof, or it may contain amino acid sequence changes. In some embodiments, the number of amino acid changes is 10 or less, 9 or less, 8 or less, 7 or less, 6 or less, 5 or less, 4 or less, 3 or less, or 2 or less. In some embodiments, the VH acceptor human framework is identical in sequence to the VH human immunoglobulin framework sequence or human consensus framework sequence.

The term "chimeric" antibody refers to an antibody in which a portion of the heavy and/or light chain is derived from a particular source or species, while the remainder of the heavy and/or light chain is derived from a different source or species.

The "class" of an antibody refers to the type of constant domain or constant region possessed by its heavy chain. There are five major classes of antibodies: IgA, IgD, IgE, IgG, and IgM, and several of these may be further divided into subclasses (isotypes), e.g. IgG1, IgG2, IgG3, IgG4, IgA1, and IgA2. The heavy chain constant domains that correspond to the different classes of immunoglobulins are called α, δ, ε, γ, and μ respectively.

A "humanized" antibody refers to a chimeric antibody comprising amino acid residues from non-human HVRs and amino acid residues from human FRs. In certain embodiments, a humanized antibody will comprise substantially all of at least one, and typically two, variable domains, in which all or substantially all of the HVRs (e.g., CDRs) correspond to those of a nonhuman antibody, and all or substantially all of the FRs correspond to those of a human antibody. A humanized antibody optionally may comprise at least a portion of an antibody constant region derived from a human antibody.

A "humanized form" of an antibody, e.g., a non-human antibody, refers to an antibody that has undergone humanization.

A "human" antibody is one which possesses an amino acid sequence which corresponds to that of an antibody produced by a human or a human cell or derived from a non-human source that utilizes human antibody repertoires or other human antibody-encoding sequences. This definition of a human antibody specifically excludes a humanized antibody comprising non-human antigen-binding residues.

The term "monoclonal antibody" as used herein refers to an antibody obtained from a population of substantially homogeneous antibodies, i.e., the individual antibodies comprising the population are identical and/or bind the same epitope, except for possible variant antibodies, e.g., containing naturally occurring mutations or arising during production of a monoclonal antibody preparation, such variants generally being present in minor amounts. In contrast to polyclonal antibody preparations, which typically include different antibodies directed against different determinants (epitopes), each monoclonal antibody of a monoclonal antibody preparation is directed against a single determinant on an antigen. Thus, the modifier "monoclonal" indicates the character of the antibody as being obtained from a substantially homogeneous population of antibodies, and is not to be construed as requiring production of the antibody by any particular method. For example, the monoclonal antibodies to be used in accordance with the present invention may be made by a variety of techniques, including but not limited to the hybridoma method, recombinant DNA methods, phage-display methods, and methods utilizing transgenic animals containing all or part of the human immunoglobulin loci.

The term "Fc domain" or "Fc region" herein is used to define a C-terminal region of an antibody heavy chain that contains at least a portion of the constant region. The term includes native sequence Fc regions and variant Fc regions. Particularly, a human IgG heavy chain Fc region extends from Cys226, or from Pro230, to the carboxyl-terminus of the heavy chain. However, the C-terminal lysine (Lys447) of the Fc region may or may not be present.

An IgG Fc region comprises an IgG CH2 and an IgG CH3 domain. The "CH2 domain" of 25 a human IgG Fc region usually extends from an amino acid residue at about position 231 to an amino acid residue at about position 340. In one embodiment, a carbohydrate chain is attached to the CH2 domain. The CH2 domain herein may be a native sequence CH2 domain or variant CH2 domain. The "CH3 domain" comprises the stretch of residues C-terminal to a CH2 domain in an Fc region (i.e. from an amino acid residue at about position 341 to an amino acid residue at about position 447 of an IgG). The CH3 region herein may be a native sequence CH3 domain or a variant CH3 domain (e.g. a CH3 domain with an introduced "protuberance" ("knob") in one chain thereof and a corresponding introduced "cavity" ("hole") in the other chain thereof; see U.S. Pat. No. 5,821,333, expressly incorporated herein by reference). Such variant CH3 domains may be used to promote heterodimerization of two non-identical antibody heavy chains as herein described. Unless otherwise specified herein, numbering of amino acid residues in the Fc region or constant region is according to the EU numbering system, also called the EU index, as described in Kabat et al., Sequences of Proteins of Immunological Interest, 5th Ed. Public Health Service, National Institutes of Health, Bethesda, Md., 1991.

The "knob-into-hole" technology is described e.g. in U.S. Pat. Nos. 5,731,168; 7,695,936; Ridgway et al., Prot Eng 9, 617-621 (1996) and Carter, J Immunol Meth 248, 7-15 (2001). Generally, the method involves introducing a protuberance ("knob") at the interface of a first polypeptide and a corresponding cavity ("hole") in the interface of a second polypeptide, such that the protuberance can be positioned in the cavity so as to promote heterodimer formation and hinder homodimer formation. Protuberances are constructed by replacing small amino acid side chains from the interface of the first polypeptide with larger side chains (e.g. tyrosine or tryptophan). Compensatory cavities of identical or similar size to the protuberances are created in the interface of the second polypeptide by replacing large amino acid side chains with smaller ones (e.g. alanine or threonine). The protuberance and cavity can be made by altering the nucleic acid encoding the polypeptides, e.g. by site-specific mutagenesis, or by peptide synthesis. In a specific embodiment a knob modification comprises the amino acid substitution T366W (EU numbering) in one of the two polypeptides of the Fc domain, and the hole modification comprises the amino acid substitutions T366S, L368A and Y407V (EU numbering) in the other one of the two polypeptides of the Fc domain. In a further specific embodiment, the polypeptide of the Fc domain comprising the knob modification additionally comprises the amino acid substitution S354C (EU numbering), and the polypeptide of the Fc domain comprising the hole modification additionally comprises the amino acid substitution Y349C (EU numbering). Introduction of these two cysteine residues results in the formation of a disulfide bridge between the two polypeptides of the Fc region, thus further stabilizing the dimer (Carter, J Immunol Methods 248, 7-15 (2001)).

A "region equivalent to the Fc region of an immunoglobulin" is intended to include naturally occurring allelic variants of the Fc region of an immunoglobulin as well as variants having alterations which produce substitutions, additions, or deletions but which do not decrease substantially the ability of the immunoglobulin to mediate effector functions (such as antibody-dependent cell-mediated cytotoxicity). For example, one or more amino acids can be deleted from the N-terminus or C-terminus of the Fc region of an immunoglobulin without substantial loss of biological function. Such variants can be selected according to general rules known in the art so as to have minimal effect on activity (see, e.g., Bowie, J. U. et al., Science 247:1306-10 (1990)).

The term "effector functions" refers to those biological activities attributable to the Fc region of an antibody, which vary with the antibody isotype. Examples of antibody effector functions include: C1q binding and complement dependent cytotoxicity (CDC), Fc receptor binding, antibody-dependent cell-mediated cytotoxicity (ADCC), antibody-dependent cellular phagocytosis (ADCP), cytokine secretion, immune complex-mediated antigen uptake by antigen presenting cells, down regulation of cell surface receptors (e.g. B cell receptor), and B cell activation.

An "activating Fc receptor" is an Fc receptor that following engagement by an Fc region of an antibody elicits signaling events that stimulate the receptor-bearing cell to perform effector functions. Activating Fc receptors include FcγRIIIa (CD16a), FcγRI (CD64), FcγRIIa (CD32), and FcαRI (CD89). A particular activating Fc receptor is human FcγRIIIa (see UniProt accession no. P08637, version 141).

The term "peptide linker" refers to a peptide comprising one or more amino acids, typically about 2 to 20 amino acids. Peptide linkers are known in the art or are described herein. Suitable, non-immunogenic linker peptides are, for example, (G4S)n (SEQ ID NO: 414), (SG4)n (SEQ ID NO: 415) or G4(SG4)n (SEQ ID NO: 416) peptide linkers, wherein "n" is generally a number between 1 and 10, typically between 2 and 4, in particular 2.

By "fused" or "connected" is meant that the components (e.g. an antigen-binding site and a FC domain) are linked by peptide bonds, either directly or via one or more peptide linkers.

The term "amino acid" as used within this application denotes the group of naturally occurring carboxy α-amino acids comprising alanine (three letter code: ala, one letter code: A), arginine (arg, R), asparagine (asn, N), aspartic acid (asp, D), cysteine (cys, C), glutamine (gln, Q), glutamic acid (glu, E), glycine (gly, G), histidine (his, H), isoleucine (ile, I), leucine (leu, L), lysine (lys, K), methionine (met, M), phenylalanine (phe, F), proline (pro, P), serine (ser, S), threonine (thr, T), tryptophan (trp, W), tyrosine (tyr, Y), and valine (val, V).

"Percent (%) amino acid sequence identity" with respect to a reference polypeptide sequence is defined as the percentage of amino acid residues in a candidate sequence that are identical with the amino acid residues in the reference polypeptide sequence, after aligning the sequences and introducing gaps, if necessary, to achieve the maximum percent sequence identity, and not considering any conservative substitutions as part of the sequence identity for the purposes of the alignment. Alignment for purposes of determining percent amino acid sequence identity can be achieved in various ways that are within the skill in the art, for instance, using publicly available computer software such as BLAST, BLAST-2, Clustal W, Megalign (DNASTAR) software or the FASTA program package. Those skilled in the art can determine appropriate parameters for aligning sequences, including any algorithms needed to achieve maximal alignment over the full length of the sequences being compared. For purposes herein, however, % amino acid sequence identity values are generated using the ggsearch program of the FASTA package version 36.3.8c or later with a BLOSUM50 comparison matrix. The FASTA program package was authored by W. R. Pearson and D. J. Lipman (1988), "Improved Tools for Biological Sequence Analysis", PNAS 85:2444-2448; W. R. Pearson (1996) "Effective protein sequence comparison" Meth. Enzymol. 266:227-258; and Pearson et. al. (1997) Genomics 46:24-36 and is publicly available from www.fasta.bioch.virginia.edu/fasta_www2/fasta_down.shtml or www. ebi.ac.uk/Tools/sss/fasta. Alternatively, a public server accessible at fasta.bioch.virginia.edu/fasta_www2/index.cgi can be used to compare the sequences, using the ggsearch (global protein: protein) program and default options (BLOSUM50; open: −10; ext: −2; Ktup=2) to ensure a global, rather than local, alignment is performed. Percent amino acid identity is given in the output alignment header.

In certain aspects, "amino acid sequence variants" of the aVHs of the invention provided herein are contemplated. For example, it may be desirable to improve the binding affinity and/or other biological properties of the aVHs. Amino acid sequence variants of the aVHs may be prepared by introducing appropriate modifications into the nucleotide sequence encoding the molecules, or by peptide synthesis. Such modifications include, for example, deletions from, and/or insertions into and/or substitutions of residues within the amino acid sequences of the aVH. Any combination of deletion, insertion, and substitution can be made to arrive at the final construct, provided that the final construct possesses the desired characteristics, e.g., antigen-binding. Sites of interest for substitutional mutagenesis include the HVRs and Framework (FRs). Conservative substitutions are provided in Table B under the heading "Preferred Substitutions" and further described below in reference to amino acid side chain classes (1) to (6). Amino acid substitutions may be introduced into the molecule of interest and the products screened for a desired activity, e.g., retained/improved antigen binding, decreased immunogenicity, or improved ADCC or CDC.

TABLE B

| Original Residue | Exemplary Substitutions | Preferred Substitutions |
| --- | --- | --- |
| Ala (A) | Val; Leu; Ile | Val |
| Arg (R) | Lys; Gln; Asn | Lys |
| Asn (N) | Gln; His; Asp, Lys; Arg | Gln |
| Asp (D) | Glu; Asn | Glu |
| Cys (C) | Ser; Ala | Ser |
| Gln (Q) | Asn; Glu | Asn |
| Glu (E) | Asp; Gln | Asp |
| Gly (G) | Ala | Ala |
| His (H) | Asn; Gln; Lys; Arg | Arg |
| Ile (I) | Leu; Val; Met; Ala; Phe; Norleucine | Leu |
| Leu (L) | Norleucine; Ile; Val; Met; Ala; Phe | Ile |
| Lys (K) | Arg; Gln; Asn | Arg |
| Met (M) | Leu; Phe; Ile | Leu |
| Phe (F) | Trp; Leu; Val; Ile; Ala; Tyr | Tyr |
| Pro (P) | Ala | Ala |
| Ser (S) | Thr | Thr |
| Thr (T) | Val; Ser | Ser |
| Trp (W) | Tyr; Phe | Tyr |
| Tyr (Y) | Trp; Phe; Thr; Ser | Phe |
| Val (V) | Ile; Leu; Met; Phe; Ala; Norleucine | Leu |

Amino acids may be grouped according to common side-chain properties:
(1) hydrophobic: Norleucine, Met, Ala, Val, Leu, Ile;
(2) neutral hydrophilic: Cys, Ser, Thr, Asn, Gln;
(3) acidic: Asp, Glu;
(4) basic: His, Lys, Arg;
(5) residues that influence chain orientation: Gly, Pro;
(6) aromatic: Trp, Tyr, Phe.

Non-conservative substitutions will entail exchanging a member of one of these classes for another class.

The term "amino acid sequence variants" includes substantial variants wherein there are amino acid substitutions in one or more hypervariable region residues of a parent antigen binding molecule (e.g. a humanized or human antibody). Generally, the resulting variant(s) selected for further study will have modifications (e.g., improvements) in certain biological properties (e.g., increased affinity, reduced immunogenicity) relative to the parent antigen binding molecule and/or will have substantially retained certain biological properties of the parent antigen binding molecule. An exemplary substitutional variant is an affinity matured antibody, which may be conveniently generated, e.g., using phage display-based affinity maturation techniques such as those described herein. Briefly, one or more HVR residues are mutated and the variant antigen binding molecules displayed on phage and screened for a particular biological activity (e.g. binding affinity). In certain embodiments, substitutions, insertions, or deletions may occur within one or more HVRs so long as such alterations do not substantially reduce the ability of the antigen binding molecule to bind antigen. For example, conservative alterations (e.g., conservative substitutions as provided herein) that do not substantially reduce binding affinity may be made in HVRs. A useful method for identification of residues or regions of an antibody that may be targeted for mutagenesis is called "alanine scanning mutagenesis" as described by Cunningham and Wells (1989) Science, 244:1081-1085. In this method, a residue or group of target residues (e.g., charged residues such as Arg, Asp, His, Lys, and Glu) are identified and replaced by a neutral or negatively charged amino acid (e.g., alanine or polyalanine) to determine whether the interaction of the antibody with antigen is affected. Further substitutions may be introduced at the amino acid locations demonstrating functional sensitivity to the initial substitutions. Alternatively, or additionally, a crystal structure of an antigen-antigen binding molecule complex to identify contact points between the antibody and antigen. Such contact residues and neighboring residues may be targeted or eliminated as candidates for substitution. Variants may be screened to determine whether they contain the desired properties.

Amino acid sequence insertions include amino- and/or carboxyl-terminal fusions ranging in length from one residue to polypeptides containing a hundred or more residues, as well as intrasequence insertions of single or multiple amino acid residues. Examples of terminal insertions include bispecific antibodies with an N-terminal methionyl residue. Other insertional variants of the molecule include the fusion to the N- or C-terminus to a polypeptide which increases the serum half-life of the aVH or the antibody comprising an aVH.

An "immunoconjugate" is an antibody conjugated to one or more heterologous molecule(s), including but not limited to a cytotoxic agent.

In certain embodiments, an antibody provided herein is a multispecific antibody, e.g. a bispecific antibody. Multispecific antibodies are monoclonal antibodies that have binding specificities for at least two different sites, i.e., different epitopes on different antigens or different epitopes on the same antigen. In certain embodiments, the multispecific antibody has three or more binding specificities. In certain embodiments, one of the binding specificities is for an antigen and the other (two or more) specificity is for any other antigen. In certain embodiments, bispecific antibodies may bind to two (or more) different epitopes of an antigen. Multispecific (e.g., bispecific) antibodies may also be used to localize cytotoxic agents or cells to cells which express the antigen. Multispecific antibodies can be prepared as full length antibodies or antibody fragments.

Techniques for making multispecific antibodies include, but are not limited to, recombinant co-expression of two immunoglobulin heavy chain-light chain pairs having different specificities (see Milstein and Cuello, *Nature* 305: 537 (1983)) and "knob-in-hole" engineering (see, e.g., U.S. Pat. No. 5,731,168, and Atwell et al., J. Mol. Biol. 270:26 (1997)). Multi-specific antibodies may also be made by engineering electrostatic steering effects for making antibody Fc-heterodimeric molecules (see, e.g., WO 2009/089004); cross-linking two or more antibodies or fragments (see, e.g., U.S. Pat. No. 4,676,980, and Brennan et al., Science, 229: 81 (1985)); using leucine zippers to produce bi-specific antibodies (see, e.g., Kostelny et al., *J. Immunol.,* 148(5):1547-1553 (1992) and WO 2011/034605); using the common light chain technology for circumventing the light chain mis-pairing problem (see, e.g., WO 98/50431); using "diabody" technology for making bispecific antibody fragments (see, e.g., Hollinger et al., *Proc. Natl. Acad. Sci. USA,* 90:6444-6448 (1993)); and using single-chain Fv (sFv) dimers (see, e.g. Gruber et al., *J. Immunol.,* 152:5368 (1994)); and preparing trispecific antibodies as described, e.g., in Tuft et al. *J. Immunol.* 147: 60 (1991).

Engineered antibodies with three or more antigen binding sites, including for example, "Octopus antibodies", or DVD-Ig are also included herein (see, e.g. WO 2001/77342 and WO 2008/024715). Other examples of multispecific antibodies with three or more antigen binding sites can be found in WO 2010/115589, WO 2010/112193, WO 2010/136172, WO2010/145792, and WO 2013/026831. The bispecific antibody or antigen binding fragment thereof also includes a "Dual Acting FAb" or "DAF" comprising an antigen binding site that binds to [[PRO]] as well as another different antigen, or two different epitopes of [[PRO]] (see, e.g., US 2008/0069820 and WO 2015/095539).

Multi-specific antibodies may also be provided in an asymmetric form with a domain crossover in one or more binding arms of the same antigen specificity, i.e. by exchanging the VH/VL domains (see e.g., WO 2009/080252 and WO 2015/150447), the CH1/CL domains (see e.g., WO 2009/080253) or the complete Fab arms (see e.g., WO 2009/080251, WO 2016/016299, also see Schaefer et al, PNAS, 108 (2011) 1187-1191, and Klein at al., MAbs 8 (2016) 1010-20). In one embodiment, the multispecific antibody comprises a cross-Fab fragment. The term "cross-Fab fragment" or "xFab fragment" or "crossover Fab fragment" refers to a Fab fragment, wherein either the variable regions or the constant regions of the heavy and light chain are exchanged. A cross-Fab fragment comprises a polypeptide chain composed of the light chain variable region (VL) and the heavy chain constant region 1 (CH1), and a polypeptide chain composed of the heavy chain variable region (VH) and the light chain constant region (CL). Asymmetrical Fab arms can also be engineered by introducing charged or non-charged amino acid mutations into domain interfaces to direct correct Fab pairing. See e.g., WO 2016/172485.

Various further molecular formats for multispecific antibodies are known in the art and are included herein (see e.g., Spiess et al., Mol Immunol 67 (2015) 95-106).

A particular type of multispecific antibodies, also included herein, are bispecific antibodies designed to simultaneously bind to a surface antigen on a target cell, e.g., a tumor cell, and to an activating, invariant component of the T cell receptor (TCR) complex, such as CD3, for retargeting of T cells to kill target cells.

Examples of bispecific antibody formats that may be useful for this purpose include, but are not limited to, the so-called "BiTE" (bispecific T cell engager) molecules wherein two scFv molecules are fused by a flexible linker (see, e.g., WO2004/106381, WO2005/061547, WO2007/042261, and WO2008/119567, Nagorsen and Bauerle, Exp Cell Res 317, 1255-1260 (2011)); diabodies (Holliger et al., Prot Eng 9, 299-305 (1996)) and derivatives thereof, such as tandem diabodies ("TandAb"; Kipriyanov et al., J Mol Biol 293, 41-56 (1999)); "DART" (dual affinity retargeting) molecules which are based on the diabody format but feature a C-terminal disulfide bridge for additional stabilization (Johnson et al., J Mol Biol 399, 436-449 (2010)), and so-called triomabs, which are whole hybrid mouse/rat IgG molecules (reviewed in Seimetz et al., Cancer Treat Rev 36, 458-467 (2010)). Particular T cell bispecific antibody formats included herein are described in WO 2013/026833, WO2013/026839, WO 2016/020309; Bacac et al., Oncoimmunology 5(8) (2016) e1203498.

The term "nucleic acid molecule" or "polynucleotide" includes any compound and/or substance that comprises a polymer of nucleotides. Each nucleotide is composed of a base, specifically a purine- or pyrimidine base (i.e. cytosine (C), guanine (G), adenine (A), thymine (T) or uracil (U)), a sugar (i.e. deoxyribose or ribose), and a phosphate group. Often, the nucleic acid molecule is described by the sequence of bases, whereby said bases represent the primary structure (linear structure) of a nucleic acid molecule. The sequence of bases is typically represented from 5' to 3'. Herein, the term nucleic acid molecule encompasses deoxyribonucleic acid (DNA) including e.g. complementary DNA (cDNA) and genomic DNA, ribonucleic acid (RNA), in particular messenger RNA (mRNA), synthetic forms of DNA or RNA, and mixed polymers comprising two or more of these molecules. The nucleic acid molecule may be linear or circular. In addition, the term nucleic acid molecule includes both, sense and antisense strands, as well as single stranded and double stranded forms. Moreover, the herein described nucleic acid molecule can contain naturally occurring or non-naturally occurring nucleotides. Examples of non-naturally occurring nucleotides include modified nucleotide bases with derivatized sugars or phosphate backbone linkages or chemically modified residues. Nucleic acid molecules also encompass DNA and RNA molecules which are suitable as a vector for direct expression of an antibody of the invention in vitro and/or in vivo, e.g. in a host or patient. Such DNA (e.g. cDNA) or RNA (e.g. mRNA) vectors, can be unmodified or modified. For example, mRNA can be chemically modified to enhance the stability of the RNA vector and/or expression of the encoded molecule so that mRNA can be injected into a subject to generate the antibody in vivo (see e.g. Stadler ert al, Nature Medicine 2017, published online 12 Jun. 2017, doi:10.1038/nm.4356 or EP 2 101 823 B1).

An "isolated" nucleic acid molecule or polynucleotide refers to a nucleic acid molecule that has been separated from a component of its natural environment. An isolated nucleic acid includes a nucleic acid molecule contained in cells that ordinarily contain the nucleic acid molecule, but the nucleic acid molecule is present extrachromosomally or at a chromosomal location that is different from its natural chromosomal location.

By an "isolated" polypeptide or a variant, or derivative thereof, particularly an isolated antibody, is intended a polypeptide that is not in its natural milieu. No particular level of purification is required. For example, an isolated polypeptide can be removed from its native or natural environment. Recombinantly produced polypeptides and proteins expressed in host cells are considered isolated for the purpose of the invention, as are native or recombinant polypeptides which have been separated, fractionated, or partially or substantially purified by any suitable technique By a nucleic acid or polynucleotide having a nucleotide sequence at least, for example, 95% "identical" to a reference nucleotide sequence of the present invention, it is intended that the nucleotide sequence of the polynucleotide is identical to the reference sequence except that the polynucleotide sequence may include up to five point mutations per each 100 nucleotides of the reference nucleotide sequence. In other words, to obtain a polynucleotide having a nucleotide sequence at least 95% identical to a reference nucleotide sequence, up to 5% of the nucleotides in the reference sequence may be deleted or substituted with another nucleotide, or a number of nucleotides up to 5% of the total nucleotides in the reference sequence may be inserted into the reference sequence. These alterations of the reference sequence may occur at the 5' or 3' terminal positions of the reference nucleotide sequence or anywhere between those terminal positions, interspersed either individually among residues in the reference sequence or in one or more contiguous groups within the reference sequence. As a practical matter, whether any particular polynucleotide sequence is at least 80%, 85%, 90%, 95%, 96%, 97%, 98% or 99% identical to a nucleotide sequence of the present invention can be determined conventionally using known computer programs, such as the ones discussed above for polypeptides (e.g. ALIGN-2).

The term "vector", as used herein, refers to a nucleic acid molecule capable of propagating another nucleic acid to which it is linked. The term includes the vector as a self-replicating nucleic acid structure as well as the vector incorporated into the genome of a host cell into which it has been introduced. Certain vectors are capable of directing the expression of nucleic acids to which they are operatively linked. Such vectors are referred to herein as "expression vectors". The terms "host cell", "host cell line", and "host cell culture" are used interchangeably and refer to cells into which exogenous nucleic acid has been introduced, including the progeny of such cells. Host cells include "transformants" and "transformed cells", which include the primary transformed cell and progeny derived therefrom without regard to the number of passages. Progeny may not be completely identical in nucleic acid content to a parent cell, but may contain mutations. Mutant progeny that have the same function or biological activity as screened or selected for in the originally transformed cell are included herein.

An "effective amount" of an agent refers to the amount that is necessary to result in a physiological change in the cell or tissue to which it is administered.

A "therapeutically effective amount" of an agent, e.g. a pharmaceutical composition, refers to an amount effective, at dosages and for periods of time necessary, to achieve the desired therapeutic or prophylactic result. A therapeutically effective amount of an agent for example eliminates, decreases, delays, minimizes or prevents adverse effects of a disease.

An "individual" or "subject" is a mammal. Mammals include, but are not limited to, domesticated animals (e.g. cows, sheep, cats, dogs, and horses), primates (e.g. humans and nonhuman primates such as monkeys), rabbits, and rodents (e.g. mice and rats). Particularly, the individual or subject is a human.

The term "pharmaceutical composition" refers to a preparation which is in such form as to permit the biological activity of an active ingredient contained therein to be effective, and which contains no additional components which are unacceptably toxic to a subject to which the formulation would be administered.

A "pharmaceutically acceptable excipient" refers to an ingredient in a pharmaceutical composition, other than an active ingredient, which is nontoxic to a subject. A pharmaceutically acceptable excipient includes, but is not limited to, a buffer, a stabilizer, or a preservative.

The term "package insert" is used to refer to instructions customarily included in commercial packages of therapeutic products, that contain information about the indications, usage, dosage, administration, combination therapy, contraindications and/or warnings concerning the use of such therapeutic products.

As used herein, "treatment" (and grammatical variations thereof such as "treat" or "treating") refers to clinical intervention in an attempt to alter the natural course of the individual being treated, and can be performed either for prophylaxis or during the course of clinical pathology. Desirable effects of treatment include, but are not limited to, preventing occurrence or recurrence of disease, alleviation of symptoms, diminishment of any direct or indirect pathological consequences of the disease, preventing metastasis, decreasing the rate of disease progression, amelioration or palliation of the disease state, and remission or improved prognosis. In some embodiments, the molecules of the invention are used to delay development of a disease or to slow the progression of a disease.

The term "cancer" as used herein refers to proliferative diseases, such as lymphomas, lymphocytic leukemias, lung cancer, non-small cell lung (NSCL) cancer, bronchioloalviolar cell lung cancer, bone cancer, pancreatic cancer, skin cancer, cancer of the head or neck, cutaneous or intraocular melanoma, uterine cancer, ovarian cancer, rectal cancer, cancer of the anal region, stomach cancer, gastric cancer, colon cancer, breast cancer, uterine cancer, carcinoma of the fallopian tubes, carcinoma of the endometrium, carcinoma of the cervix, carcinoma of the vagina, carcinoma of the vulva, Hodgkin's Disease, cancer of the esophagus, cancer of the small intestine, cancer of the endocrine system, cancer of the thyroid gland, cancer of the parathyroid gland, cancer of the adrenal gland, sarcoma of soft tissue, cancer of the urethra, cancer of the penis, prostate cancer, cancer of the bladder, cancer of the kidney or ureter, renal cell carcinoma, carcinoma of the renal pelvis, mesothelioma, hepatocellular cancer, biliary cancer, neoplasms of the central nervous system (CNS), spinal axis tumors, brain stem glioma, glioblastoma multiforme, astrocytomas, schwanomas, ependymonas, medulloblastomas, meningiomas, squamous cell carcinomas, pituitary adenoma and Ewings sarcoma, including refractory versions of any of the above cancers, or a combination of one or more of the above cancers.

The term "autonomous VH (aVH) domain" refers to a single immunoglobulin heavy chain variable (VH) domain that retains the immunoglobulin fold, i.e. it is a variable domain in which up to three complementarity determining regions (CDR) along with up to four framework regions (FR) form the antigen-binding site.

The term "immunoglobulin molecule" refers to a protein having the structure of a naturally occurring antibody, as described hereinbefore.

For discussion of Fab and F(ab')2 fragments comprising salvage receptor binding epitope residues and having increased in vivo half-life, see U.S. Pat. No. 5,869,046. Diabodies are antibody fragments with two antigen-binding sites that may be bivalent or bispecific. See, for example, EP 404,097; WO 1993/01161; Hudson et al., Nat Med 9, 129-134 (2003); and Hollinger et al., Proc Natl Acad Sci USA 90, 6444-6448 (1993). Triabodies and tetrabodies are also described in Hudson et al., Nat Med 9, 129-134 (2003). Single-domain antibodies are antibody fragments comprising all or a portion of the heavy chain variable domain as defined herein. In certain embodiments, a single-domain antibody is a human single-domain antibody (Domantis, Inc., Waltham, MA; see e.g. U.S. Pat. No. 6,248,516 B1). Antibody fragments can be made by various techniques, including but not limited to proteolytic digestion of an intact antibody as well as production by recombinant host cells (e.g. *E. coli* or phage), as described herein.

The polypeptide sequences of the Sequence Listing are not numbered according to the Kabat numbering system. However, it is well within the ordinary skill of one in the art to convert the numbering of the sequences of the Sequence Listing to Kabat numbering or to the EU numbering system, also called the EU index, as described in Kabat et al., *Sequences of Proteins of Immunological Interest*, 5th Ed. Public Health Service, National Institutes of Health, Bethesda, MD, 1991. If the sequence is directed to CDRs, the Kabat numbering applies. If the sequence is directed to the Fc domain, the EU index applies.

The term "amino acid mutation" as used herein is meant to encompass amino acid substitutions, deletions, insertions, and modifications. Any combination of substitution, deletion, insertion, and modification can be made to arrive at the final construct, provided that the final construct possesses the desired characteristics. Amino acid sequence deletions and insertions include amino- and/or carboxy-terminal deletions and insertions of amino acids. Particular amino acid mutations are amino acid substitutions. For the purpose of altering certain characteristics of a peptide, non-conservative amino acid substitutions, i.e. replacing one amino acid with another amino acid having different structural and/or chemical properties, are particularly preferred. Amino acid substitutions include replacement by non-naturally occurring amino acids or by naturally occurring amino acid derivatives of the twenty standard amino acids (e.g. 4-hydroxyproline, 3-methylhistidine, ornithine, homoserine, 5-hydroxylysine). Amino acid mutations can be generated using genetic or chemical methods well known in the art. Genetic methods may include site-directed mutagenesis, PCR, gene synthesis and the like. It is contemplated that methods of altering the side chain group of an amino acid by methods other than genetic engineering, such as chemical modification, may also be useful. Various designations may be used herein to indicate the same amino acid mutation. For example, a substitution from alanine at position 71 of the VH domain to cysteine can be indicated as 71C, A71C, or Ala71Cys.

As used herein, term "polypeptide" refers to a molecule composed of monomers (amino acids) linearly linked by amide bonds (also known as peptide bonds). The term "polypeptide" refers to any chain of two or more amino acids, and does not refer to a specific length of the product. Thus, peptides, dipeptides, tripeptides, oligopeptides, "protein," "amino acid chain," or any other term used to refer to a chain of two or more amino acids, are included within the definition of "polypeptide," and the term "polypeptide" may be used instead of, or interchangeably with any of these terms. The term "polypeptide" is also intended to refer to the products of post-expression modifications of the polypeptide, including without limitation glycosylation, acetylation, phosphorylation, amidation, derivatization by known protecting/blocking groups, proteolytic cleavage, or modification by non-naturally occurring amino acids. A polypeptide may be derived from a natural biological source or produced by recombinant technology, but is not necessarily translated from a designated nucleic acid sequence. It may be generated in any manner, including by chemical synthesis. A polypeptide of the invention may be of a size of about 3 or more, 5 or more, 10 or more, 20 or more, 25 or more, 50 or more, 75 or more, 100 or more, 200 or more, 500 or more, 1,000 or more, or 2,000 or more amino acids. Polypeptides may have a defined three-dimensional structure, although they do not necessarily have such structure. Polypeptides with a defined three-dimensional structure are referred to as folded, and polypeptides which do not possess a defined three-dimensional structure, but rather can adopt a large number of different conformations, and are referred to as unfolded.

Conditions allowing the formation of a disulfide bond relate to oxidative conditions e.g. as found in the periplasm of bacteria or in the endoplasmatic reticulum of eukaryotic cells.

Additionally, the amino acid pair forming the disulfide should have a distance between the Cα/Cα of 4-6 Å.

II. Embodiments of the Invention aVHS

In one aspect, the invention is based, in part, on stabilized autonomous VH domains. In certain embodiments an autonomous VH domain is provided comprising cysteines in position 52a and 71 or positions 33 and 52 according to Kabat numbering. Said cysteines are capable of forming a disulfide bond and/or form disulfide bonds under suitable conditions. In a further aspect of the invention, an autonomous VH domain is provided comprising cysteines in position 52a, 71, 33 and 52 according to Kabat numbering. In a preferred embodiment of the invention, the a VH comprises a heavy chain variable domain framework comprising a framework region 1 according to the amino acid sequence of SEQ ID NO: 207 or a framework region 2 according to the amino acid sequence of SEQ ID NO: 208 or a framework region 3 according to the amino acid sequence of SEQ ID NO: 209 or a framework region 4 according to the amino acid sequence of SEQ ID NO: 210. In a preferred embodiment of the invention, the a VH comprises a heavy chain variable domain framework comprising a framework region 1 according to the amino acid sequence of SEQ ID NO: 207 and a framework region 2 according to the amino acid sequence of SEQ ID NO: 208. In a preferred embodiment of the invention, the a VH comprises a heavy chain variable domain framework comprising a framework region 1 according to the amino acid sequence of SEQ ID NO: 209 and a framework region 3 according to the amino acid sequence of SEQ ID NO: 210. In a preferred embodiment of the invention, the a VH comprises a heavy chain variable domain framework comprising a framework region 1 according to the amino acid sequence of SEQ ID NO: 207 and a framework region 4 according to the amino acid sequence of SEQ ID NO: 210. In a preferred embodiment of the invention, the a VH comprises a heavy chain variable domain framework comprising a framework region 1 according to the amino acid sequence of SEQ ID NO: 207, a framework region 3 according to the amino acid sequence of SEQ ID NO: 209 and a framework region 4 according to the amino acid sequence of SEQ ID NO: 210. In a preferred embodiment of the invention, the a VH comprises a heavy chain variable domain framework comprising a framework region 1 according to the amino acid sequence of SEQ ID NO: 207, a framework region 2 according to the amino acid sequence of SEQ ID NO: 208 and a framework region 3 according to the amino acid sequence of SEQ ID NO: 209. In a preferred embodiment of the invention, the a VH comprises a heavy chain variable domain framework comprising a framework region 1 according to the amino acid sequence of SEQ ID NO: 207, a framework region 2 according to the amino acid sequence of SEQ ID NO: 208, a framework region 3 according to the amino acid sequence of SEQ ID NO: 209 and a framework region 4 according to the amino acid sequence of SEQ ID NO: 210. In a preferred embodiment of the invention, the a VH comprises a heavy chain variable domain framework comprising a framework region 2 according to the amino acid sequence of SEQ ID NO: 208, a framework region 3 according to the amino acid sequence of SEQ ID NO: 209 and a framework region 4 according to the amino acid sequence of SEQ ID NO: 210. In a preferred embodiment of the invention, the a VH comprises a heavy chain variable domain framework comprising a framework region 2 according to the amino acid sequence of SEQ ID NO: 208 and a framework region 3 according to the amino acid sequence of SEQ ID NO: 209. In a preferred embodiment of the invention, the a VH comprises a heavy chain variable domain framework comprising a framework region 2 according to the amino acid sequence of SEQ ID NO: 208 and a framework region 4 according to the amino acid sequence of SEQ ID NO: 220. In a preferred embodiment of the invention, the a VH comprises a heavy chain variable domain framework comprising a framework region 3 according to the amino acid sequence of SEQ ID NO: 209 and a framework region 4 according to the amino acid sequence of SEQ ID NO: 210. Alternatively, framework region 1 is according to SEQ ID NO: 211 in the aforementioned embodiments, wherein framework region 1 was defined according to SEQ ID NO: 207.

In one preferred embodiment of the invention the aVH comprises a VH3_23 human framework. In one preferred embodiment of the invention the framework is based on the VH framework of Herceptin® (trastuzumab).

aVH Templates

In a further aspect of the invention, template aVHs are provided. In a preferred embodiment the autonomous VH domain comprises the amino acid sequence of SEQ ID NO: 40 (template 1). The amino acid sequence of SEQ ID NO: 40 is based on the cysteine mutations in positions P52aC and A71C. In a preferred embodiment the autonomous VH domain comprises the amino acid sequence of SEQ ID NO: 42 (template 2). The amino acid sequence of SEQ ID NO: 42 is based on the cysteine mutations in positions P52aC and A71C, and comprises a further mutation, namely G26S. In a preferred embodiment the autonomous VH domain comprises the amino acid sequence of SEQ ID NO: 44 (template 3). The amino acid sequence of SEQ ID NO: 42 is based on the cysteine mutations in positions P52aC and A71C, and comprises a serine insertion at position 31a, meaning a serine was added to the sequence between position 31 and 32. In a preferred embodiment the autonomous VH domain comprises the amino acid sequence of SEQ ID NO: 46 (template 4). The amino acid sequence of SEQ ID NO: 44 is based on the cysteine mutations in positions P52aC and A71C, and comprises two serine insertion at positions 31a and 31b, meaning two serines were added to the sequence between position 31 and 32. In a preferred embodiment the autonomous VH domain comprises the amino acid sequence of SEQ ID NO: 180 (template 5). The amino acid sequence of SEQ ID NO: 180 is based on the cysteine mutations in positions Y33C and Y52. The sequences of SEQ ID NOs 40, 42, 44, 46 and 180 comprise, for further stabilization purposes, the mutations K94S and L108T. However, the templates 1 to 5 do not need to comprise K94S and/or L198T mutations.

In a preferred embodiment of the invention the autonomous VH domain comprises at least 95% sequence identity to the amino acid sequence of SEQ ID NO: 40. In a preferred embodiment of the invention the autonomous VH domain comprises at least 95% sequence identity to the amino acid sequence of SEQ ID NO: 42. In a preferred embodiment of the invention the autonomous VH domain comprises at least 95% sequence identity to the amino acid sequence of SEQ ID NO: 44. In a preferred embodiment of the invention the autonomous VH domain comprises at least 95% sequence identity to the amino acid sequence of SEQ ID NO: 46. In a preferred embodiment of the invention the autonomous VH domain comprises at least 95% sequence identity to the amino acid sequence of SEQ ID NO: 180.

In a preferred embodiment of the invention the autonomous VH domain comprises the mutations H35G, and/or Q39R, and/or L45E or L45T, and/or W47L.

aVH Binders for Specific Targets

In a further aspect, the invention is based, in part, on aVH domains that bind to melanoma-associated chondroitin sulfate proteoglycan (MCSP). In a preferred embodiment the aVH domain binding to MCSP comprises the amino acid sequence of SEQ ID NO: 57. In a preferred embodiment the aVH domain binding to MCSP comprises the amino acid sequence of SEQ ID NO: 59. In a preferred embodiment the aVH domain binding to MCSP comprises the amino acid sequence of SEQ ID NO: 61. In a preferred embodiment the aVH domain binding to MCSP comprises the amino acid sequence of SEQ ID NO: 63. In a preferred embodiment the aVH domain binding to MCSP comprises the amino acid sequence of SEQ ID NO: 65.

In a further aspect, the invention is based, in part, on aVH domains that bind to transferrin receptor 1 (TfR1). In a preferred embodiment the aVH domain binding to TfR1 comprises the amino acid sequence of SEQ ID NO: 194. In a preferred embodiment the aVH domain binding to TfR1 comprises the amino acid sequence of SEQ ID NO: 195. In a preferred embodiment the aVH domain binding to TfR1 comprises the amino acid sequence of SEQ ID NO: 196. In a preferred embodiment the aVH domain binding to TfR1 comprises the amino acid sequence of SEQ ID NO: 197. In a preferred embodiment the aVH domain binding to TfR1 comprises the amino acid sequence of SEQ ID NO: 198. In a preferred embodiment the aVH domain binding to TfR1 comprises the amino acid sequence of SEQ ID NO: 199. In a preferred embodiment the aVH domain binding to TfR1 comprises the amino acid sequence of SEQ ID NO: 200.

In one aspect, the invention is based, in part, on aVH domains that bind to lymphocyte-activation gene 3 (LAG3). In a preferred embodiment the aVH domain binding to LAG3 comprises (i) a CDR1 with the sequence of SEQ ID NO: 146, a CDR2 with the sequence of SEQ ID NO: 147 and a CDR3 with the sequence of SEQ ID NO: 148. In a more preferred embodiment of the invention the aVH domain comprises the amino acid sequence of SEQ ID NO: 77.

In a preferred embodiment the aVH domain binding to LAG3 comprises (ii) a CDR1 with the sequence of SEQ ID NO: 149, a CDR2 with the sequence of SEQ ID NO: 150 and a CDR3 with the sequence of SEQ ID NO: 151. In a more preferred embodiment of the invention the aVH domain comprises the amino acid sequence of SEQ ID NO: 79.

In a preferred embodiment the aVH domain binding to LAG3 comprises (iii) a CDR1 with the sequence of SEQ ID NO: 152, a CDR2 with the sequence of SEQ ID NO: 153 and a CDR3 with the sequence of SEQ ID NO: 154. In a more preferred embodiment of the invention the aVH domain comprises the amino acid sequence of SEQ ID NO: 81.

In a preferred embodiment the aVH domain binding to LAG3 comprises (iv) a CDR1 with the sequence of SEQ ID NO: 155, a CDR2 with the sequence of SEQ ID NO: 156 and a CDR3 with the sequence of SEQ ID NO: 157. In a more preferred embodiment of the invention the aVH domain comprises the amino acid sequence of SEQ ID NO: 83.

In a preferred embodiment the aVH domain binding to LAG3 comprises (v) a CDR1 with the sequence of SEQ ID NO: 158, a CDR2 with the sequence of SEQ ID NO: 159 and a CDR3 with the sequence of SEQ ID NO: 160. In a more preferred embodiment of the invention the aVH domain comprises the amino acid sequence of SEQ ID NO: 85.

In a preferred embodiment the aVH domain binding to LAG3 comprises (vi) a CDR1 with the sequence of SEQ ID NO: 161, a CDR2 with the sequence of SEQ ID NO: 162 and a CDR3 with the sequence of SEQ ID NO: 163 (corresponding to CDRs of anti-LAG3 aVH domain P110D1). In a more preferred embodiment of the invention the aVH domain comprises the amino acid sequence of SEQ ID NO: 87.

In a preferred embodiment the aVH domain binding to LAG3 comprises (vii) a CDR1 with the sequence of SEQ ID NO: 164, a CDR2 with the sequence of SEQ ID NO: 165 and a CDR3 with the sequence of SEQ ID NO: 166. In a more preferred embodiment of the invention the aVH domain comprises the amino acid sequence of SEQ ID NO: 89.

In a preferred embodiment the aVH domain binding to LAG3 comprises (viii) a CDR1 with the sequence of SEQ ID NO: 167, a CDR2 with the sequence of SEQ ID NO: 168 and a CDR3 with the sequence of SEQ ID NO: 169. In a more preferred embodiment of the invention the aVH domain comprises the amino acid sequence of SEQ ID NO: 91.

In a preferred embodiment the aVH domain binding to LAG3 comprises (ix) a CDR1 with the sequence of SEQ ID NO: 170, a CDR2 with the sequence of SEQ ID NO: 171 and a CDR3 with the sequence of SEQ ID NO: 172. In a more preferred embodiment of the invention the aVH domain comprises the amino acid sequence of SEQ ID NO: 93.

In a preferred embodiment the aVH domain binding to LAG3 comprises (x) a CDR1 with the sequence of SEQ ID NO: 173, a CDR2 with the sequence of SEQ ID NO: 174 and a CDR3 with the sequence of SEQ ID NO: 175. In a more preferred embodiment of the invention the aVH domain comprises the amino acid sequence of SEQ ID NO: 95.

In a preferred embodiment the aVH domain binding to LAG3 comprises (xi) a CDR1 with the sequence of SEQ ID NO: 176, a CDR2 with the sequence of SEQ ID NO: 177 and a CDR3 with the sequence of SEQ ID NO: 178. In a more preferred embodiment of the invention the aVH domain comprises the amino acid sequence of SEQ ID NO: 97.

VH Library

For the generation of a VH libraries comprising autonomous VH domains as described herein the template sequences were randomized. Template 1 (according to SEQ ID NO: 40) was randomized in all three CDRs. The templates 2, 3 and 4 (according to SEQ ID NO: 42, SEQ ID NO: 44; SEQ ID NO: 46, respectively) were randomized in CDR2 and CDR3. Template 5 (according to SEQ ID NO: 180) was randomized in all three CDRs for a first library and only randomized in CDR 2 and 3 for a second library.

III. Examples

The following are examples of methods and compositions of the invention. It is understood that various other embodiments may be practiced, given the general description provided above.

Recombinant DNA Techniques

Standard methods were used to manipulate DNA as described in Sambrook, J. et al, Molecular cloning: A laboratory manual; Cold Spring Harbor Laboratory press, Cold spring Harbor, New York, 1989. The molecular biological reagents were used according to the manufacturer's instructions. General information regarding the nucleotide sequences of human immunoglobulin light and heavy chains is given in: Kabat, E. A. et al. (1991) Sequences of Proteins of Immunological Interest, Fifth Ed., NIH Publication No 91-3242.

Gene Synthesis

Desired gene segments, where required, were either generated by PCR using appropriate templates or were synthesized at Geneart AG (Regensburg, Germany) from synthetic oligonucleotides and PCR products by automated gene synthesis. The gene segments flanked by singular restriction endonuclease cleavage sites were cloned into standard cloning/sequencing vectors. The plasmid DNA was purified from transformed bacteria and concentration determined by UV spectroscopy. The DNA sequence of the sub-cloned gene fragments was confirmed by DNA sequencing. Gene segments were designed with suitable restriction sites to allow sub-cloning into the respective expression vectors. All constructs used for secretion in eukaryotic cells were designed with a 5'-end DNA sequence coding for a leader peptide. SEQ ID NOs 1 and 2 give exemplary leader peptides.

Cloning of Antigen Expression Vectors

For the selection of specific aVH domains, 3 different antigens were generated.

A DNA fragment encoding amino acids 1553 to 2184 of "matured melanoma-associated chondroitin sulfate proteoglycan" (MCSP, Uniprot: Q6UVK1) was cloned in frame into a mammalian recipient vector containing an N-terminal leader sequence. In addition, the construct contains a C-terminal avi-tag allowing specific biotinylation during co-expression with Bir A biotin ligase and a His-tag used for purification by immobilized-metal affinity chromatography (IMAC) (SEQ ID NOs 3 and 4).

An amplified DNA fragment encoding amino acids 122 to 760 of the human transferrin receptor 1 (TfR1, Uniprot: P02786) was inserted in frame into a mammalian recipient vector downstream of a hum IgG1 Fc coding fragment which serves as solubility- and purification tag. An N-terminal avi-tag allowed in vivo biotinylation. In order to express the antigen in a monomeric state, the Fc-TfR1 fusion construct contained the "hole" mutations (SEQ ID NOs 5 and 6) and was co-expressed in combination with an "Fc-knob" counterpart (SEQ ID NOs 7 and 8).

For Death receptor 5 (DR5, Uniprot: O14763), a DNA fragment encoding the extracellular domain (amino acids 1 to 152) was inserted in frame into a mammalian recipient vector with an N-terminal leader sequence upstream of a hum IgG1 Fc coding fragment. A C-terminal avi-tag allowed specific in vivo biotinylation (SEQ ID NOs 9 and 10).

The antigen expression of MCSP, TfR1, and DR5 is generally driven by an MPSV promoter and transcription is terminated by a synthetic polyA signal sequence located downstream of the coding sequence. In addition to the expression cassette, each vector contains an EBV oriP sequence for autonomous replication in EBV-EBNA expressing cell lines.

For the generation of soluble human Lag3-IgG1-Fc- with biotinylated C-terminal Avi-tag, plasmid 21707_pIntronA_shLag3_huIgG1-Fc-Avi was generated by gene synthesis (GeneArt GmbH) of human Lag3 extracellular domain (pos. 23-450 of sw: lag3_human) and a IEGRMD-linker (SEQ ID NO: 442) N-terminally of position Pro100 until Gly329 of a human IgG1-heavy chain cDNA expression vector, which has an Avi-tag sequence (5' GSGLNDIFEAQKIEWHE (SEQ ID NO: 417)) C-terminally attached (SEQ ID NOs 11 and 12).

Production and Purification of Fc Fusion Constructs and His Tag Construct

For the expression of DR5-Fc-avi, monomeric TfR1-Fc-avi, as well as mono- and bivalent aVH Fc constructs were transiently transfected into HEK 293 cells, stably expressing the EBV-derived protein EBNA. Proteins were purified from filtered cell culture supernatants referring to standard protocols. In brief, Fc-containing proteins were applied to a Protein A Sepharose column (GE healthcare) and washed with PBS. Elution was achieved at pH 2.8 followed by immediate neutralization of the sample. Aggregated protein was separated from the monomeric fraction by size exclusion chromatography (Superdex 200, GE Healthcare) in PBS or in 20 mM Histidine, 150 mM NaCl pH 6.0. Monomeric protein fractions were pooled, concentrated (if required) using e.g., a MILLIPORE Amicon Ultra (30 MWCO) centrifugal concentrator, frozen and stored at −20° C. or −80° C. Part of the samples were provided for subsequent protein analytics and analytical characterization e.g. by SDS-PAGE, size exclusion chromatography (SEC) or mass spectrometry.

For the expression of LAG3-Fc-avi, the final Plasmid 21707_pIntronA_shLag3_huIgG1-Fc-Avi transfected into Expi293™ Expression System (Life Technologies) in 2 liter scale, according to manufacturer's instructions. The supernatant was harvested and purified via Protein A column chromatography. The purified protein was biotinylated via BirA biotin-protein Ligase standard reaction kit (Avidity) pursuant to manufacturer's instructions. Protease-Inhibitor mini EDTA free (Roche) was added to avoid proteolysis of the protein. By the use of a gel filtration column (Superdex200 16/60, GE), the free biotin as well as BirA Ligase was removed from the biotinylated protein. Biotinylation was confirmed by adding streptavidin. The resulting biotinylated protein/streptavidin complex showed a shift of the retention time in the analytical SEC chromatogram.

Constructs expressing a his-tag were transiently transfected into HEK 293 cells, stably expressing the EBV-derived protein EBNA (HEK EBNA). A simultaneously co-transfected plasmid encoding the biotin ligase BirA allowed avi-tag-specific biotinlylation in vivo. Proteins were purified from filtered cell culture supernatants referring to standard protocols using immobilized metal affinity chromatography (IMAC) followed by gel filtration. Monomeric protein fractions were pooled, concentrated (if required), frozen and stored at −20° C. or −80° C. Part of the samples were provided for subsequent protein analytics and analytical characterization e.g. by SDS-PAGE, size exclusion chromatography (SEC) or mass spectrometry.

Example 1

Generation of a Generic Autonomous Human Heavy Chain Variable Domains (aVH) Library A generic aVH library was generated on the basis of the sequence Blab, a Herceptin-derived template for autonomous human heavy chain variable domains published by Barthelemy et al., J. Biol. Chem. 2008, 283:3639-3654, (SEQ ID NOs: 13 and 14). In Blab, four 4 residues that become exposed to the surface in the absence of a light chain interface were replaced by residues which were identified by phage display. These mutations are found to be compatible with the structure of the VH domain fold. They increase hydrophilicity and hence the stability of the scaffold and allow expression of aVH domains that are stable and soluble in the absence of a light chain partner (FIG. 1A).

For the generation of an aVH phage display library based on the sequence of Blab and randomized in the CDR3 region, 2 fragments were assembled by "splicing by overlapping extension" (SOE) PCR. Fragment 1 comprises the 5' end of the aVH-encoding gene including framework 3, whereas fragment 2 comprises the end of framework 3, the randomized CDR3 region and framework 4 of the aVH fragment.

The following primer combinations were used to generate the library fragments: fragment 1 (LMB3 (SEQ ID NO: 15) and DP47_CDR3 back (mod) (SEQ ID NO: 16)) and fragment 2 (DP47-v4 primers (SEQ ID NOs: 18-20) and fdseqlong (SEQ ID NO: 17)) (Table 1). For the generation of this library, 3 different CDR3 lengths were used (FIG. 2B). After assembly of sufficient amounts of full length randomized aVH fragments, they were digested with NcoI/NotI alongside with equally cleaved acceptor phagemid vector. 6 μg of Fab library insert were ligated with 24 μg of phagemid vector. Purified ligations were used for 60 transformations resulting in 6×10$^9$ transformants. Phagemid particles displaying the aVH library were rescued and purified by PEG/NaCl purification to be used for selections.

TABLE 1

Primer combinations for the generation
of the CDR3-randomized aVH library
CDR3-randomized library based on template B1ab

| fragment | 5'Primer | 3'Primer |
|---|---|---|
| PCR1 | LMB3 | DP47_CDR3 back (mod) fdseqlong |
| PCR2 | DP47_v4_4 | |
| | DP47_v4_6 | |
| | DP47_v4_8 | |

Selection of Anti DRS Binders from a Generic aVH Library

In order to test the functionality of the new library, selection against the extracellular domain (ECD) of DRS was carried out using HEK293-expressed proteins. Panning rounds were performed in solution according to the following pattern: (1.) binding of ~$10^{12}$ phagemid particles to 100 nM biotinylated antigen protein for 0.5 h in a total volume of 1 ml, (2.) capture of biotinylated antigen and attachment of specifically binding phage by addition of $5.4\times10^7$ streptavidin-coated magnetic beads for 10 min, (3.) washing of the beads using 5×1 ml PBS/Tween20 and 5×1 lml PBS, (4.) elution of phage particles by addition of 1 ml 100 mM triethylamine (TEA) for 10 min and neutralization by addition of 500 µl 1M Tris/HCl pH 7.4, (5.) Re-infection of exponentially growing E. coli TG1 cells with the phage particles in the supernatant, infection with helperphage VCSM13 and subsequent PEG/NaCl precipitation of phagemid particles to be used in subsequent selection rounds.

Selections were carried out over 3 rounds using decreasing (from $10^{-7}$ M to $5\times10^{-9}$ M) antigen concentrations. In round 2, capture of antigen:phage complexes was performed using neutravidin plates instead of streptavidin beads. Specific binders were identified by ELISA as follows: 100 µl of 50 nM biotinylated antigen per well were coated on neutravidin plates. Fab-containing bacterial supernatants were added and binding Fabs were detected via their Flag-tags by using an anti-Flag/HRP secondary antibody. Clones exhibiting significant signals over background were short-listed for sequencing (SEQ ID NOs: 21-28).

Example 2

Identification of aVH Domains Containing a Stabilizing Disulfide Bridge

In order to further stabilize the aVH scaffold, the introduction of additional disulfides bridges constraining the flexibility of the protein chain was tested. Positions that allow the formation of a disulfide bridge when mutated to cysteines were identified either by 1) structural modeling or by 2) searching for Ig-like V-type sequences in nature that harbor additional stabilizing disulfides.

In the first approach, the crystal structure of the molecule with the closest structural homology to the used aVH was identified. (www.pdb.org, entry No. 3B9V). Using a computer algorithm, 63 pairs of amino acids with the distance of the Ca/Ca pairs below 5 Å were identified. From this 63 pairs, amino acid pairs with strong impact on core packing or obvious violations of the Cβ/Cβ geometry were excluded. As a result, 8 different pairs of residues were selected In the second approach, a manual database screen was performed in order to identify germline-encoded V-type domains of the immunoglobulin family with disulfide bridges in addition to the canonical disulfide bond between positions 22 and 92 (Kabat numbering). Already known disulfide patterns from llama, camel or rabbits were avoided explicitly. In one example, a sequence from catfish (Ictalurus punctatus, AY238373) was identified that harbored two additional cysteines at positions 33 and 52. Searching of the protein structural database (www.pdb.org) revealed two existing natural antibodies having this disulfide pattern present (PDB entries 1AI1 and 1ACY), which was introduced for the first time into a human antibody scaffold.

All selected variants harboring two additional cysteines that are in close proximity and therefore allow the formation of a stabilizing disulfide bridge were individually tested for a beneficial influence on the stability of the domain. All variants were generated based on a sequence derivative of a previously identified DRS-specific binder (SEQ ID NO 38). For the analysis of the disulfide-stabilizing effect, all variants were fused to the N-terminal end of an Fc (knob) fragment harboring the knob mutations in the CH3 region (SEQ ID NOs: 29, 30, 31, 32, 33, 34, 35, 36, 37, 38). Co-expression with a respective Fc-hole fragment resulted in an asymmetric, monovalent aVH-Fc fusion construct (FIG. 2A). Expression and purification in HEK-EBNA cells was performed as described above. Stability of the constructs was assessed by heat-induced aggregation which was measured by dynamic light scattering (DLS). Table 3 shows the measured aggregation temperatures of the respective constructs. Based on these results, 2 variants (DS-Des9 (Cys Y33C/Y52C) (SEQ ID NO: 30) and DS-Des2 (Cys P52aC/A71C) (SEQ ID NO: 37)) were selected as a basis for the generation of aVH randomization libraries.

TABLE 3

List of disulfide pairs that were introduced in the aVH
scaffold and the respective aggregation temperature

| Clone | $T_{agg}$ (° C.) |
|---|---|
| Template (SEQ ID NO: 38) | 57 |
| DS-Des1 (Cys40/88) | 52 |
| DS-Des2 (Cys52a/71) | 61 |
| DS-Des3 (Cys49/69) | 52 |
| DS-Des4 (Cys91/106) | 61 |
| DS-Des5 (Cys11/110) | 61 |
| DS-Des6 (Cys82c/111) | 55 |
| DS-Des7 (Cys6/107) | 61 |
| DS-Des8 (Cys39/89) | 50 |
| DS-Des9 (Cys33/52) | 64 |

Example 3

New Library Templates for the Generation of Stabilized Generic Autonomous Human Heavy Chain Variable Domain (aVH) Libraries Based on the SEQ ID NOs 30 and 37, new aVH library templates were designed for the generation of aVH libraries with higher stability. The following optional modifications were made in the template sequences: (1) introduction of the mutation K94S. (2) Introduction of the mutation L108T, a frequent sequence variant found in the antibody J-element. However. the aforementioned mutations had no specific effect. An overview on all library templates is given in FIG. 3.

Generation of New Generic Autonomous Human Heavy Chain Variable Domain (aVH) Libraries Harboring the Stabilizing Disulfide Bridge 52a/71

For the generation of new aVH libraries based on the additional stabilizing disulfide bridge at positions 52a and 71, four new templates were designed (SEQ ID NOs: 39, 41, 43, 45). Three out of the four templates harbor additional sequence modifications in the CDR1 region (FIG. 3A). In template 2 (SEQ ID NO: 42), glycine 26 was replaced by serine (G26S modification), templates 3 and 4 (SEQ ID NOs: 44 and 46) have one and two serine insertions at positions 31a and 31a/b, respectively (S31a and S31ab modifications). Template 1 (SEQ ID NO: 40) was randomized in all 3 CDRs, templates 2-4 (SEQ ID NO: 42, 44, and 46) only in CDR2 and CDR3. For all randomizations, 3 fragments were assembled by "splicing by overlapping extension" (SOE) PCR. Fragment 1 comprises the 5' end of the aVH gene including framework1, CDR1, and parts of framework 2. Fragment 2 overlaps with fragment 1 in framework 2 and encodes CDR2 and the framework 3 region. Fragment 3 anneals with fragment 2 and harbors the CDR3 region and the C-terminal end of the aVH.

For the randomization of all 3 CDRs, the following primer combinations were used to generate the library fragments: fragment 1 (LMB3 (SEQ ID NO: 14) and aVH_P52aC_A71C_H1_rev_Primer_TN (SEQ ID NO: 47), fragment 2 (aVH_P52aC_A71C_H2 for_Primer_TN (SEQ ID NO: 48) and aVH_H3 reverse Primer (SEQ ID NO: 49), and fragment 3 (aVH_H3_4/5/6_for_Primer_TN (SEQ ID NOs: 50-52) and fdseqlong (SEQ ID NO: 17)) (Table 4). For the generation of the 3 libraries that were only randomized in CDR2 and 3, the randomization primer SEQ ID NO: 15 was replaced with the constant primer SEQ ID NO: 53 (Table 5). After assembly of sufficient amounts of full length randomized aVH fragments, they were digested with NcoI/ NotI alongside with similarly treated acceptor phagemid vector. 6 µg of aVH library insert were ligated with 24 µg of phagemid vector. Purified ligations were used for 60 transformations resulting in $5 \times 10^9$ to $10^{10}$ transformants. Phagemid particles displaying the aVH library were rescued and purified by PEG/NaCl purification to be used for selections.

TABLE 4

Primer combinations for the generation of new
stabilized aVH libraries randomized in all three CDRs
CDR1, 2, and3-randomized library based on template 1:
E45T P52aC A71C K94S L108T

| fragment | 5'Primer | 3'Primer |
|---|---|---|
| PCR1 | LMB3 | aVH_P52aC_A71C_H1_rev_Primer_TN |
| PCR2 | aVH_P52aC_A71C_H2_for_Primer_TN | aVH_H3 reverse Primer |
| PCR3 | aVH_H3_4_for_Primer_TN<br>aVH_H3_5_for_Primer_TN<br>aVH_H3_6_for_Primer_TN | fdseqlong |

TABLE 5

Primer combinations for the generation of new stabilized
aVH libraries randomized in CDR1 and 2.
CDR2 and3-randomized library based on templates 2, 3, and 4:
G26S E45T P52aC A71C K94S L108T
31aS E45T P52aC A71C K94S L108T
31aS 31bS E45T P52aC A71C K94S L108T

| fragment | 5'Primer | 3'Primer |
|---|---|---|
| PCR1 | LMB3 | aVH H1 const rev |
| PCR2 | aVH_P52aC_A71C_H2_for_Primer_TN | aVH_H3 reverse Primer |
| PCR3 | aVH_H3_4_for_Primer_TN<br>aVH_H3_5_for_Primer_TN<br>aVH_H3_6_for_Primer_TN | fdseqlong |

Generation of New Generic Autonomous Human Heavy Chain Variable Domain (aVH) Libraries Harboring the Stabilizing Disulfide Bridge 33/52

For the randomization of the aVH template 5 (FIG. 3B; DNA: SEQ ID NO: 179; protein: SEQ ID NO: 180), stabilized by the disulfide bridge at positions 33 and 52, the same PCR strategy was chosen as described before. For the generation of a library with 3 randomized CDRs, fragment 1 was generated using primers LMB3 (SEQ ID NO: 15) and aVH_Y33C_Y52C_H1_rev_Primer_TN (SEQ ID NO: 54), fragment 2 using aVH_Y33C_Y52C_H2_for_Primer_TN (SEQ ID NO: 55) and aVH_H3 reverse Primer (SEQ ID NO: 49) and fragment 3 using aVH_H3_4/5/6_for_Primer_TN (SEQ ID NOs: 50-52) and fdseqlong (SEQ ID NO: 17) (Table 6). For the generation of a library randomized only in CDR2 and 3, the randomization primer SEQ ID NO: 54 was replaced with the constant primer SEQ ID NO: 53 (Table 7). The size of the resulting phage libraries was about $5 \times 10^9$ transformants.

TABLE 6

Primer combinations for the generation of new stabilized
aVH libraries randomized in all three CDRs
CDR1, 2, and 3-randomized library based on template 5:
Y33C E45T Y52C K94S L108T

| fragment | 5'Primer | 3'Primer |
|---|---|---|
| PCR1 | LMB3 | aVH_Y33C_Y52C_H1_rev_Primer_TN |
| PCR2 | aVH_Y33C_Y52C_H2_for_Primer_TN | aVH_H3 reverse Primer |
| PCR3 | aVH_H3_4_for_Primer_TN<br>aVH_H3_5_for_Primer_TN<br>aVH_H3_6_for_Primer_TN | fdseqlong |

TABLE 7

Primer combinations for the generation of
new stabilized aVH libraries
randomized in CDR1 and 2.
CDR2 and 3-randomized library based
on template 5:
Y33C E45T Y52C K94S L108T

| fragment | 5'Primer | 3'Primer |
|---|---|---|
| PCR1 | LMB3 | aVH H1 const rev |
| PCR2 | aVH_Y33C_Y52C_H2_for_Primer_TN | aVH_H3 reverse Primer |
| PCR3 | aVH_H3_4_for_Primer_TN<br>aVH_H3_5_for_Primer_TN<br>aVH_H3_6_for_Primer_TN | fdseqlong |

Example 4

Selection of Anti-MCSP and Anti TfR1 Binders from Generic Disulfide-Stabilized aVH Libraries In order to test the quality of the complexity of the libraries and to further characterize the resulting binders, proof of concept selections against recombinant MCSP and TfR1 were performed in solution as described before. For both selections, all six phage libraries were individually screened for binders against the mentioned antigens. Selections were carried out over 3 rounds using decreasing (from $10^{-7}$ M to $\times 10^{-8}$ M) antigen concentrations. In round 2, capture of antigen:phage complexes was performed using neutravidin plates instead of streptavidin beads. Specific binders were identified by ELISA as follows: 100 µl of 50 nM biotinylated antigen per well were coated on neutravidin plates. Individual aVH-containing bacterial supernatants were added and binding aVHs were detected via their Flag-tags by using an anti-Flag/HRP secondary antibody. Clones exhibiting significant signals over background were short-listed for sequencing (exemplary DNA sequences listed as SEQ ID NO: 56, 58, 60, 62, and 64 for MCSP-specific aVHs and SEQ ID NO: 66, 67, 68, 69, 70, 71 and 72 for TfR1-specific aVHs) and further analyses.

Purification of aVHs from E. coli

For the further characterization of the selected clones, ELISA-positive aVHs (exemplary protein sequences of variable domains listed as SEQ ID NOs: 57, 59, 61, 63 and 65 for MCSP-specific aVHs) were purified for the exact analysis of the kinetic parameters. For each clone, a 500 ml culture was inoculated with bacteria harboring the corresponding phagemid and induced with 1 mM IPTG at an $OD_{600}$ 0.9. Afterwards, the cultures were incubated at 25° C. overnight and harvested by centrifugation. After incubation of the resuspended pellet for 20 min in 25 ml PPB buffer (30 mM Tris-HCl pH8, 1 mM EDTA, 20% sucrose), bacteria were centrifuged again and the supernatant was harvested. This incubation step was repeated once with 25 ml of a 5 mM $MgSO_4$ solution. The supernatants of both incubation steps were pooled, filtered and loaded on an IMAC column (His gravitrap, GE Healthcare). Subsequently, the column was washed with 40 ml washing buffer (500 mM NaCl, 20 mM Imidazole, 20 mM $NaH_2PO_4$ pH 7.4). After the elution (500 mM NaCl, 500 mM Imidazole, 20 mM $NaH_2PO_4$ pH 7.4) the eluate was re-buffered using PD10 columns (GE Healthcare) followed by an gel filtration step. The yield of purified protein was in the range of 500 to 2000 µg/l.

Affinity-Determination of the MCSP-Specific Disulfide-Stabilized aVH Clones by SPR Affinity ($K_D$) of selected aVH clones was measured by surface plasmon resonance using a ProteOn XPR36 instrument (Biorad) at 25° C. with biotinylated MCSP antigen immobilized on NLC chips by neutravidin capture. Immobilization of recombinant antigens (ligand): Antigen was diluted with PBST (10 mM phosphate, 150 mM sodium chloride pH 7.4, 0.005% Tween 20) to 10 µg/ml, then injected at 30 µl/minute at varying contact times, to achieve immobilization levels of 200, 400 or 800 response units (RU) in vertical orientation. Injection of analytes: For one-shot kinetics measurements, injection direction was changed to horizontal orientation, two-fold dilution series of purified aVH (varying concentration ranges between 200 and 6.25 nM) were injected simultaneously at 60 µl/min along separate channels 1-5, with association times between 180 s, and dissociation times of 800 s. Buffer (PBST) was injected along the sixth channel to provide an "in-line" blank for referencing. Association rate constants ($k_{on}$) and dissociation rate constants ($k_{off}$) were calculated using a simple one-to-one Langmuir binding model in ProteOn Manager v3.1 software by simultaneously fitting the association and dissociation sensorgrams. The equilibrium dissociation constant ($K_D$) was calculated as the ratio $k_{off}/k_{on}$. Analyzed clones revealed $K_D$ values in a very broad range (between 8 and 193 nM). The kinetic and thermodynamic data, the aggregation temperature, the randomized CDRs as well as the location of the stabilizing disulfide bridge of all clones are summarized in Table 8.

TABLE 8

Kinetic and thermodynamic parameters of stabilized anti-MCSP aVH domains

| clone | ka (1/Ms) | kd (1/s) | $K_D$ (nM) | CDR1 modification | random. CDRs | S-S bridge | $T_{agg}$ (°C) |
|---|---|---|---|---|---|---|---|
| 2 | 4.58E+05 | 3.39E−03 | 8 | G26S | 2 and 3 | P52aC A71C | 61 |
| 3 | 2.20E+05 | 8.67E−03 | 39 | G26S | 2 and 3 | P52aC A71C | 64 |
| 25 | 8.07E+04 | 1.56E−02 | 193 | G26S | 2 and 3 | P52aC A71C | 60 |
| 44 | 1.50E+05 | 1.63E−02 | 109 | N/A | 1, 2, and 3 | P52aC A71C | n.d. |
| 57.1 | 2.95E+05 | 1.42E−02 | 48 | N/A | 1, 2, and 3 | Y33C Y52C | 59 |

Conversion of the Selected Disulfide-Stabilized aVH Clones into an Fc-Based Format In order to further characterize the selected aVH clones, all binders were converted into Fc-based formats. The MCSP-specific aVH sequences were N-terminally fused to a human IgG1 Fc domain harboring the "knob" mutations. In particular, the identified aVH DNA sequences (SEQ ID NO: 56, 58, 60, 62, 64) replaced the aVH-encoding template sequence of SEQ ID NO: 73. The aVH-Fc fusion sequences were expressed in combination with a Fc sequence carrying the "hole" mutation (SEQ ID NO: 74) resulting in Fc domains with an N-terminal monomeric aVH (FIG. 2A).

For the TfR1-specific binders, an alternative Fc-based format was chosen: Based on a human IgG1 antibody, the sequence encoding the VH domain was replaced by the DNA sequence fragment coding for the selected aVH domains (SEQ ID NO: 66, 67, 68, 69, 70, 71 and 72). Furthermore, in the expression construct which encodes a light chain of the kappa type, the VL domain was deleted and the constant kappa domain (SEQ ID NO: 75) was directly fused to the signal sequence. Co-expression of both plasmids leads to a bivalent construct consisting of all antibody constant domains and an aVH domain fused to N-terminal end of each CH1 (FIG. 2B). These constructs were used for all further characterizations.

Binding Analysis of the MCSP-Specific Disulfide-Stabilized aVH Clones

Figure 4:
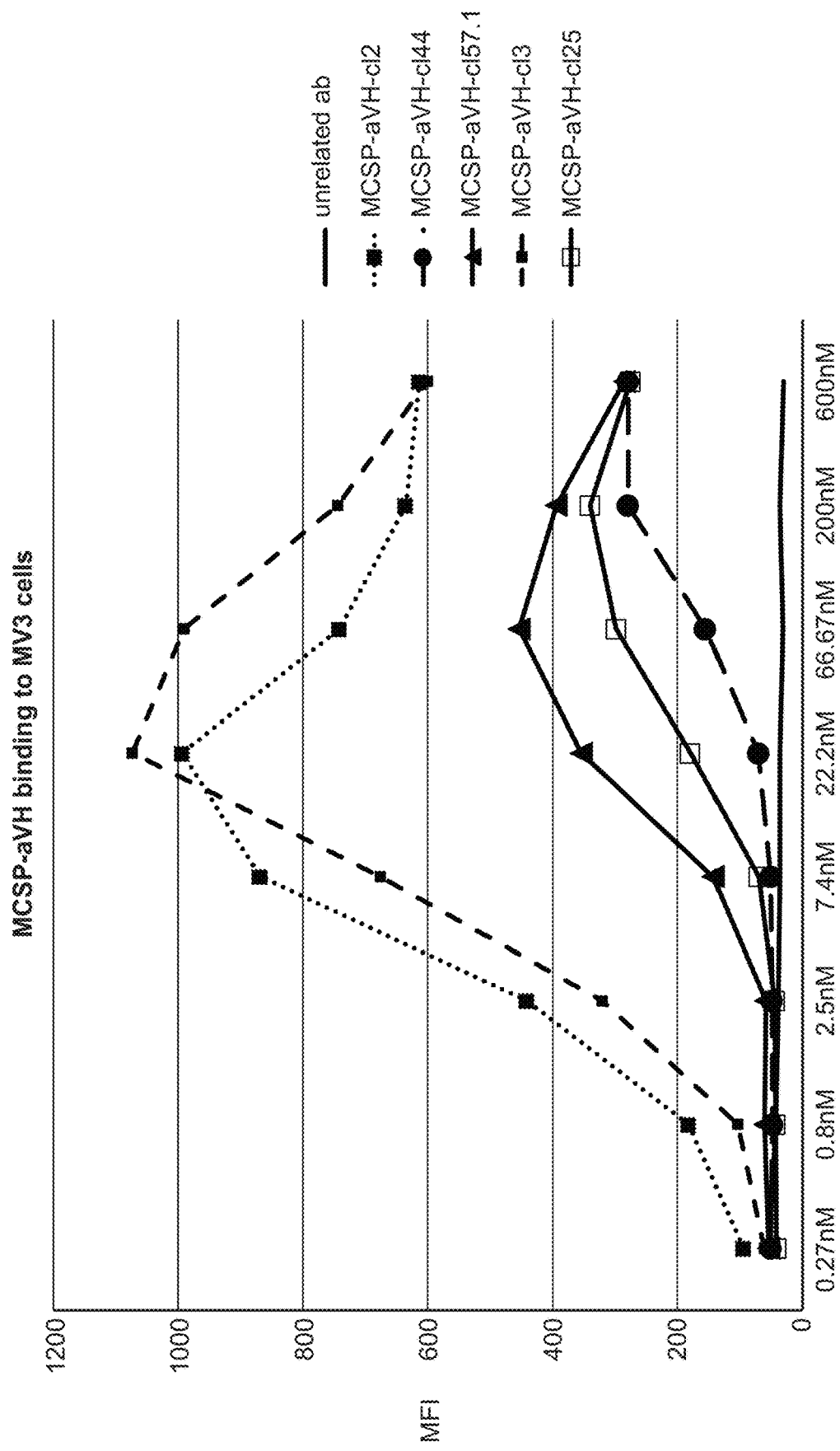
FIG. 4: Cell binding analysis by flow cytometry. Binding analysis of selected MCSP-specific clones to MV3 cells as monovalent aVH-Fc fusion constructs. The concentration range was between 0.27 and 600 nM. An isotype control antibody served as a negative control.

Binding of the disulfide-stabilized MCSP-specific clones to the MV3 cell line was measured by FACS. As a negative control, an unrelated antibody was used. 0.2 million cells per well in a 96 well round bottom plate were incubated in 300 µl PBS (0.1% BSA) with monomeric aVH-Fc fusion constructs (0.27, 0.8, 2.5, 7.4, 22.2, 66.6, 200, and 600 nM) for 30 min at 4° C. Unbound molecules were removed by washing the cells with PBS (0.1% BSA). Bound molecules were detected with a FITC-conjugated AffiniPure goat anti-human IgG Fc gamma fragment-specific secondary F(ab')2 fragment (Jackson ImmunoResearch #109-096-098; working solution 1:20 in PBS, 0.1% BSA). After 30 min incubation at 4° C., unbound antibody was removed by washing and cells were fixed using 1% PFA. Cells were analyzed using BD FACS CantoII (Software BD DIVA). Binding of all clones (FIG. 4) was observed. The affinity measured by SPR and the sensitivity in the binding analysis correlate, clone 2 (SEQ ID NO: 57) was the best binder in both SPR analysis and the cell binding study.

Characterization of the Selected MCSP-Specific Disulfide-Stabilized aVH Clones

For further characterization of the selected and purified aVHs, the aggregation temperature of the MCSP-specific clones was determined as described before. Interestingly, the aggregation temperature of all disulfide-stabilized MCSP-specific clones were between 59 and 64° C., clearly demonstrating the stabilizing effect of the additional disulfide bridge (Table 8).

Figure 5:
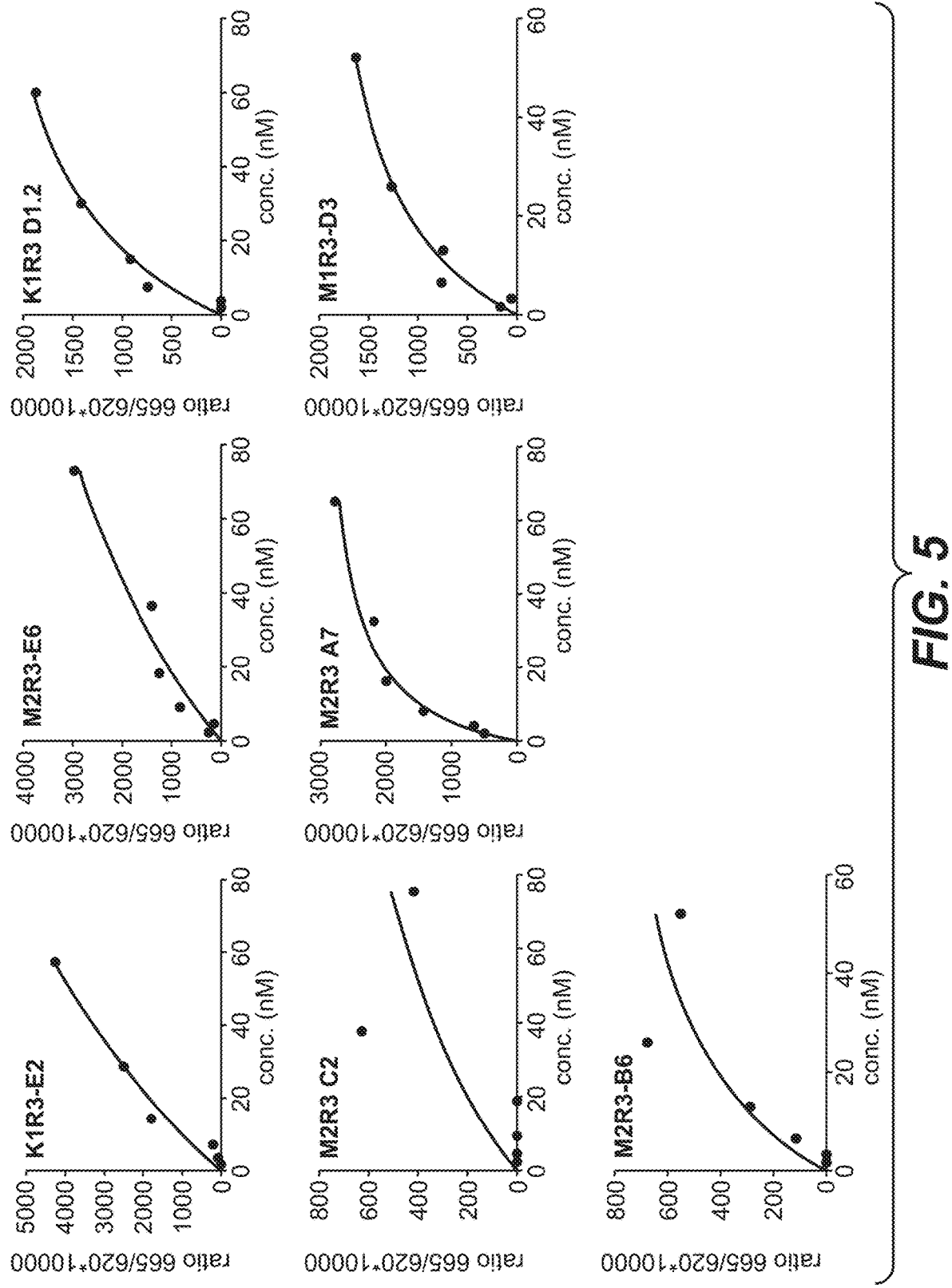
FIG. 5: FRET analysis of TfR1-specific aVH clones. FRET analysis on transiently transfected cells expressing a transmembrane TfR1-SNAP tag fusion protein labeled with terbium. Analysis was done by adding antibodies at a concentration ranging from 0.4 up to 72 nM followed by the addition of an anti-humanFc-d2 (final 200 nM per well) as acceptor molecule. Specific FRET signal was measured after 3 h and $K_D$ values were calculated.

Fluorescence Resonance Energy Transfer Assay of TfR1-Specific Disulfide-Stabilized aVH Clones Binding of the TfR1-specific bivalent aVH-Fc constructs to their epitope on TfR1-expressing cells was determined by Fluorescence Resonance Energy Transfer (FRET) analysis. For this analysis, the DNA sequence encoding for the SNAP Tag (plasmid purchased from Cisbio) was amplified by PCR and ligated into an expression vector, containing the full length TfR1 sequence (Origene). The resulting fusion protein comprises full-length TfR1 with a C-terminal SNAP tag. Hek293 cells were transfected with 10 µg DNA using Lipofectamine 2000 as transfection reagent. After an incubation for 20 h, cells were washed with PBS and incubated for 1 h at 37° C. in LabMed buffer (Cisbio) containing 100 nM SNAP-Lumi4Tb (Cibsio), leading to specific labeling of the SNAP Tag. Subsequently, cells were washed 4 times with LabMed buffer to remove unbound dye. The labeling efficiency was determined by measuring the emission of Terbium at 615 nm compared to buffer. Cells were then stored frozen at −80° C. for up to 6 months. Binding was measured by adding TfR1-specific aVH Fc fusions at a concentration ranging from 0.5 up to 60 nM to labeled cells (100 cells per well) followed by addition of anti-humanFc-d2 (Cisbio, final concentration was 200 nM per well) as acceptor molecule for the FRET. After an incubation time of 3 h at RT the emission of the acceptor dye (665 nm) as well as of the donor dye (615 nm) was determined using a fluorescence Reader (Victor 3, Perkin Elmer). The ratio of acceptor to donor emission was calculated and the ratio of the background control (cells with anti-huFc-d2) subtracted. Curves were analysed in GraphPad Prism5 (FIG. 5) and Kos calculated (Table 9).

TABLE 9

Thermodynamic parameters of stabilized anti-TfR1 aVH domains

| Clone | affinity measured by SPR (nM) |
|---|---|
| aTfR1 aVH K1R3-E2 | 152.2 |
| aTfR1 aVH M2R3-E6 | 112.4 |
| aTfR1 aVH K1R3 D1.2 | 34.59 |
| aTfR1 aVH M2R3 C2 | 92.51 |
| aTfR1 aVH M2R3 A7 | 11.63 |
| aTfR1 aVH M1R3-D3 | 23.56 |
| aTfR1 aVH M2R3-B6 | 28.54 |

Example 5

Selection of Anti-LAG3-Specific Binders from Generic Disulfide-Stabilized aVH Libraries The selection of LAG3-specific aVHs was performed as described before. For this selection, all six phage libraries were individually screened for binders against the mentioned antigens. Selections were carried out over 3 rounds using decreasing (from $10^{-7}$ M to $\times 10^{-8}$ M) antigen concentrations. In round 2, capture of antigen:phage complexes was performed using neutravidin plates instead of streptavidin beads. Specific binders were identified by ELISA as follows: 100 µl of 50 nM biotinylated antigen per well were coated on neutravidin plates. aVH-containing bacterial supernatants were added and binding aVHs were detected via their Flag-tags by using an anti-Flag/HRP secondary antibody. Clones exhibiting significant signals over background were short-listed for sequencing (DNA sequences listed as SEQ ID NOs: 76, 78, 80, 82, 84, 86, 88, 90, 92, 94, 96; protein sequences listed as SEQ ID NOs: 77, 79, 81, 83, 85, 87, 89, 91, 93, 95, 97) and further analyses.

Affinity-Determination of the LAG3-Specific Disulfide-Stabilized aVH Clones by SPR Affinity ($K_D$) of selected aVH clones was measured by surface plasmon resonance using a ProteOn XPR36 instrument (Biorad) at 25° C. with biotinylated LAG3-Fc antigen immobilized on NLC chips by neutravidin capture. Immobilization of recombinant antigens (ligand): Antigen was diluted with PBST (10 mM phosphate, 150 mM sodium chloride pH 7.4, 0.005% Tween 20) to 10 µg/ml, then injected at 30 µl/minute at varying contact times, to achieve immobilization levels of 200, 400 or 800 response units (RU) in vertical orientation. As a negative control for LAG3 binding interaction, a biotinylated Fc domain was immobilized at the same conditions. Injection of analytes: For one-shot kinetics measurements, injection direction was changed to horizontal orientation. Two-fold dilution series of *E. coli*-derived purified aVH (varying concentration ranges between 200 and 6.25 nM) were injected simultaneously at 60 µl/min along separate channels 1-5 for an association time of 300 s and a dissociation time of 360 s. Buffer (PBST) was injected along the sixth channel to provide an "in-line" blank for referencing. Association rate constants ($k_{on}$) and dissociation rate constants ($k_{off}$) were calculated using a simple one-to-one Langmuir binding model in ProteOn Manager v3.1 software by simultaneously fitting the association and dissociation sensorgrams. The equilibrium dissociation constant ($K_D$) was calculated as the ratio $k_{off}/k_{on}$. Analyzed clones revealed $K_D$ values in a very broad range (between 5 and 766 nM). The kinetic and thermodynamic data, the aggregation temperature, the randomized CDRs as well as the location of the stabilizing disulfide bridge of all clones are summarized in Table 10.

TABLE 10

Thermodynamic parameters of anti-LAG3 aVH domains.

| clone | ka (1/Ms) | kd (1/s) | KD (nM) | CDR1 modification | random. CDRs | S-S bridge | $T_{agg}$ (° C.) |
|---|---|---|---|---|---|---|---|
| LAG3 17D7 | 1.59E+04 | 4.93E-03 | 311 | not applicable | 2 and 3 | Y33C Y52C | 65 |
| LAG3 21B11 | 6.27E+04 | 2.17E-03 | 43 | not applicable | 2 and 3 | Y33C Y52C | 66 |
| LAG3 P11A2 | 2.51E+05 | 1.38E-02 | 55 | G26S | 2 and 3 | P52aC A71C | 73 |
| LAG3 P21A03 | 2.82E+04 | 3.87E-04 | 13.7 | not applicable | 2 and 3 | Y33C Y52C | 75 |
| LAG3 P9G1 | 1.62E+05 | 8.29E-04 | 5.1 | not applicable | 2 and 3 | Y33C Y52C | 77 |
| LAG3 P10D1 | 1.44E+05 | 3.83E-03 | 27 | not applicable | 1, 2, and 3 | Y33C Y52C | 76 |
| LAG3 P10C3 | 5.62E+04 | 2.17E-03 | 38.5 | not applicable | 2 and 3 | Y33C Y52C | 79 |
| LAG3 P11E9 | 9.63E+04 | 6.56E-04 | 6.81 | not applicable | 2 and 3 | Y33C Y52C | 77 |
| LAG3 9B4 | 3.65E+04 | 3.14E-03 | 86 | not applicable | 2 and 3 | Y33C Y52C | 61 |
| LAG3 19G3 | 6.08E+03 | 4.66E-03 | 766 | not applicable | 2 and 3 | Y33C Y52C | n.d. |
| LAG3 P11E2 | 4.28E+04 | 1.57E-03 | 36.7 | not applicable | 2 and 3 | Y33C Y52C | 75 |

MHCII Competition Assay on A375 Cells with aVH Domains Purified from Bacteria

In order to assess the ability of bacteria-purified LAG3-specific aVH domains to block and prevent LAG3 from binding to MHCII expressed on T cells, a cell-based binding inhibition assay was performed using aVHs domains purified from bacteria. In a first step, a serial dilution of aVH domains ranging from 20 µg/ml to 0.05 µg/ml was incubated in PFAE buffer (PBS with 2% FCS, 0.02% sodium azide, and 1 mM EDTA) with 1 µg/ml biotinylated LAG3-Fc. After 20 minutes at room temperature, the mixture was added to 2×10exp5 PFAE-washed A375 cells. After 30 minutes at 4° C., cells were washed once with PFAE. Binding of LAG3-Fc to MHCII expressed on A375 cells was detected by addition of an Alexa 647-labeled goat anti human Fc. After 30 minutes of incubation, cells were washed in PFAE buffer and binding analysis was carried out using a FACS calibur flow cytometer.

Example 6

Conversion of the Selected Disulfide-Stabilized aVH Clones into Fc-Based Formats In order to further characterize the selected aVH clones, all binders were converted into Fc-based formats. The aVH-encoding sequences were N-terminally fused either to human IgG1 Fc domain or a human IgG1 Fc domain harboring the "knob" mutations. Both Fc-variants contained the PG-LALA mutations which completely abolish FcγR binding. The PG-LALA mutations relating to mutation in the Fc domain of P329G, L234A and L235A (EU numbering) are described in WO 2012/130831, which is incorporated herein in its entirety.

While expression of the resulting aVH-Fc (PG-LALA) fusion sequences (DNA sequences with SEQ ID NOs: 98, 100, 102, 104, 106, 108, 110, 112, 114, 116, 118 and respective protein sequences with SEQ ID NOs: 99, 101, 103, 105, 107, 109, 111, 113, 115, 117, 119) yielded bivalent Fc fusion constructs (FIG. 2C), co-expression of the aVH Fc(knob, PG-LALA) fusion constructs (DNA sequences with SEQ ID NOs: 120, 122, 124, 126, 128, 120, 132, 134, 136, 138, 140 and respective protein sequences with SEQ ID NOs: 121, 123, 125, 127, 129, 131, 133, 135, 137, 139, 141) with an Fc sequence fragment carrying the "hole" mutations (SEQ ID NO: 74) resulted in monovalent aVH-Fc fusion constructs (FIG. 2A). Production and purification of the molecules was performed as described previously.

Biochemical Characterization of the Monovalent aVH-Fc Fusion Constructs

In order to characterize and compare their biochemical and biophysical properties, all monovalent aVH-Fc fusion constructs were analyzed in detail:

Chemical Degradation Test

Samples were split into three aliquots and re-buffered into 20 mM His/His-HCl, 140 mM NaCl, pH 6.0 (His/NaCl) or into PBS, respectively, and stored at 40° C. (His/NaCl) or 37° C. (PBS) for 2 weeks. A control sample was stored at −80° C.

After incubation ended, samples were analyzed for relative active concentration (SPR), aggregation (SEC) and fragmentation (CE-SDS) and compared with the untreated control.

Hydrophobic Interaction Chromatography (HIC)

Apparent hydrophobicity was determined by injecting 20 μg of sample onto a HIC-Ether-5PW (Tosoh) column equilibrated with 25 mM Na-phosphate, 1.5 M ammonium sulfate, pH 7.0. Elution was performed with a linear gradient from 0 to 100% buffer B (25 mM Na-phosphate, pH 7.0) within 60 minutes. Retention times were compared to protein standards with known hydrophobicity. Most antibodies display a relative retention time between 0 and 0.35.

Thermal Stability

Samples are prepared at a concentration of 1 mg/mL in 20 mM His/His-HCl, 140 mM NaCl, pH 6.0, transferred into an optical 384-well plate by centrifugation through a 0.4 μm filter plate and covered with paraffin oil. The hydrodynamic radius is measured repeatedly by dynamic light scattering on a DynaPro Plate Reader (Wyatt) while the samples are heated with a rate of 0.05° C./min from 25° C. to 80° C.

FcRn Affinity Chromatography

FcRn was expressed, purified and biotinylated as described (Schlothauer et al.). For coupling, the prepared receptor was added to streptavidin-sepharose (GE Healthcare). The resulting FcRn-sepharose matrix was packed in a column housing. The column was equilibrated with 20 mM 2-(N-morpholine)-ethanesulfonic acid (MES), 140 mM NaCl, pH 5.5 (eluent A) at a 0.5 ml/min flow rate. 30 μg of antibody samples were diluted at a volume ratio of 1:1 with eluent A and applied to the FcRn column. The column was washed with 5 column volumes of eluent A followed by elution with a linear gradient from 20 to 100% 20 mM Tris/HCl, 140 mM NaCl, pH 8.8 (eluent B) in 35 column volumes. The analysis was performed with a column oven at 25° C. The elution profile was monitored by continuous measurement of the absorbance at 280 nm. Retention times were compared to protein standards with known affinities. Most antibodies display a relative retention time between 0 and 1.

Table 11 summarizes biophysical and biochemical properties of the different tested samples. All showed unexpectedly high thermal stability and apparent hydrophobicity. However, clones 17D7 and 19G3 showed an abnormally strong binding to FcRn. All samples showed only minor fragmentation upon stress (Table 12), but clones P11E2 and P11E9 displayed a significant aggregation propensity upon stress (Table 12). Finally, SPR measurements revealed that all samples but P11A2 retained most of their binding properties to their Lag3 target after stress (relative active concentration >80%) (Table 13).

TABLE 11

Biophysical and biochemical properties of different tested molecules

| Clone (monomeric aVH-Fc) | $T_{agg}$ (° C.) | Apparent relative hydrophobicity | Relative FcRn affinity |
|---|---|---|---|
| 17D7 | 65[1] | 0.20 | 1.39 |
| 21B11 | 66[1] | 0.10 | 1.06 |
| P11A2 | 73 | 0.12 | 0.88 |
| P21A03 | 75 | 0.31 | 0.99 |
| P9G1 | 77 | 0.12 | 0.85 |
| P10D1 | 76 | 0.18 | 0.93 |
| P10C3 | 79 | 0.15 | 0.89 |
| P11E9 | 77 | 0.18 | 0.89 |
| 9B4 | 61 | 0.26 | 1.01 |
| 19G3 | not determined | 0.23 | 1.49 |
| P11E2 | 75 | 0.32 | 1.19 |

[1]experiment performed with corresponding symmetric bivalent molecules

TABLE 12

Integrity of different tested molecules after stress

| | His/NaCl, 40° C. Stress | | PBS, 37° C. Stress | |
|---|---|---|---|---|
| Sample | SEC Main Peak Change (% area) | CE-SDS Main Peak Change (% area) | SEC Main Peak Change (% area) | CE-SDS Main Peak Change (% area) |
| 17D7 | −0.1 | 0.0 | −0.5 | 0.0 |
| 21B11 | −0.2 | 0.0 | −0.6 | 0.0 |
| P11A2 | −1.1 | −1.4 | 0.2 | 0.2 |
| P21A03 | −0.7 | 0.0 | −0.8 | 0.0 |
| P9G1 | 0.0 | 0.0 | −0.7 | 0.0 |
| P10D1 | −0.2 | 0.0 | −0.6 | −1.2 |
| P10C3 | −0.2 | 0.2 | −0.6 | 0.2 |
| P11E9 | −1.3 | −1.3 | −5.7 | −0.3 |
| 9B4 | −0.5 | 0.0 | −1.0 | 0.0 |
| 19G3 | −0.4 | −2.4 | −0.5 | −1.0 |
| P11E2 | −2.7 | 0.0 | −3.8 | −0.3 |

TABLE 13

Relative active concentration (%) of different tested molecules after stress

| Sample | His/NaCl, 40° C. Stress | PBS, 37° C. Stress |
|---|---|---|
| 17D7 | 101 | 98 |
| 21B11 | 94 | 92 |
| P11A2 | 78 | 104 |
| P21A03 | 99 | 107 |
| P9G1 | 94 | 98 |
| P10D1 | 100 | 104 |
| P10C3 | 97 | 99 |
| P11E9 | 88 | 90 |
| 9B4 | n.a.[1] | 91 |
| 19G3 | 99 | 91 |
| P11E2 | 84 | 93 |

[1]n.a.: not available

Example 7

In Vitro Characterization of the Bivalent aVH-Fc Fusion Constructs

For the in vitro experiments described below, the following reagents were used. A summary of all results can be found in Table 14.

Materials used were PBS (DPBS, PAN, PO4-36500), BSA (Roche, 10735086001), Tween 20 (Polysorbat 20 (usb, #20605, 500 ml)), PBST blocking buffer (PBS (10×, Roche,

11666789001)/2% BSA (Bovine Serum Albumin Fraction V, fatty acid free, Roche, #10735086001)/0.05% Tween 20), One Step ELISA Buffer (OSEP) (PBS (10×, Roche, #11666789001), 0.5% BSA (Bovine Serum Albumin Fraction V, fatty acid free, Roche, #10735086001), 0.05% Tween 20).

TABLE 14

In vitro characterization of bivalent aVH-Fc fusion constructs

| | human LAG3 ELISA | | | SPR off-rate | |
|---|---|---|---|---|---|
| clone | OD max | EC50 (ng/ml) | EC50 (nM) | kd (1/s) | t½ (min) |
| P11A2 aVH-Fc | 1.3 | x | x | 4.8E−03* | 2.4 |
| P9G1 aVH-Fc | 1.9 | 13.2 | 0.2 | 2.0E−05 | 589.4 |
| 9B4 aVH-Fc | 1.2 | 19.4 | 0.3 | 1.9E−04 | 61.1 |
| P10D1 aVH-Fc | 0.9 | 112.7 | 1.5 | 1.1E−04 | 102.2 |
| 17D7 aVH-Fc | 1.2 | 14.5 | 0.2 | 1.8E−04 | 65.9 |
| P11E9 aVH-Fc | 1.9 | 121.0 | 1.6 | 2.4E−05 | 489.5 |
| P21A03 aVH-Fc | 1.8 | 90.1 | 1.2 | 1.0E−05 | 1155.2 |
| 21B11 aVH-Fc | 1.1 | 15.7 | 0.2 | 1.8E−5 | 107 |
| P11E2 aVH-Fc | 1.1 | 143.5 | 1.9 | 6.8E−05 | 169.9 |
| 19G3 aVH-Fc | 1.0 | 34.2 | 0.5 | 2.9E−04 | 40.3 |
| P10C3 aVH-Fc | 0.8 | 123.4 | 1.6 | 8.9E−05 | 130.5 |
| MDX 25F7 | 3.39 | 3.1 | 0.02 | 3.9E−04 | 30 |

*poor fit
x = plateau not reached

ELISA on Human Lag3

Nunc maxisorp plates (Nunc 464718) were coated with 25 µl/well recombinant human LAG3 Fc Chimera Protein (R&D Systems, 2319-L3) diluted in PBS buffer, at a protein concentration of 800 ng/ml and incubated at 4° C. overnight or for 1 h at room temperature. After washing (3×90 µl/well with PBST-buffer) each well was incubated with 90 µl blocking buffer (PBS+2% BSA+0.05% Tween 20) for 1 h at room temperature. After washing (3×90 µl/well with PBST-buffer) 25 µl anti-Lag3 aVH samples at a concentration of 1000 or 3000-0.05 ng/ml (1:3 dilutions in OSEP buffer) were added and incubated 1 h at RT. After washing (3×90 µl/well with PBST-buffer) 25 µl/well goat anti-Human IgG F(ab')2-HRP conjugate (Jackson, JIR109-036-006) was added in a 1:800 dilution and incubated at RT for 1 h. After washing (3×90 µl/well with PBST-buffer) 25 TMB substrate (Roche, 11835033001) was added and incubated for 2-10 min. Measurement was performed on a Tecan Safire 2 instrument at 370/492 nm. Compared to the control antibody MDX (25F7 as disclosed in US2011/0150892 and WO2014/008218), most aVH clones showed higher EC50 values. In addition, a respective ELISA experiment using murine LAG3-Fc antigen (R&D Systems, 3328-L3-050) revealed that none of the binders is cross-reactive to murine LAG3 (data not shown).

Off-Rate Determination

Off-rates of anti-Lag3 aVH Fc fusion constructs from binding to human Lag3 were investigated by surface plasmon resonance using a BIACORE B4000 or T200 instruments (GE Healthcare). All experiments were performed at 25° C. using PBST Buffer (pH 7.4+0.05% Tween20) as running buffer. Anti-human Fc (JIR109-005-098, Jackson) was immobilized on a Series S Cl Sensor Chip (GE Healthcare) to −240-315 RU. 1 or 5 µg/ml anti-Lag3 aVH antibody was captured for 60 sec at 10 µl/min. In the next step free anti-human Fc binding sites were blocked by injection of human IgG (Jackson, JIR-009-000-003) with 2×120 sec injections, 10 µl/min at a concentration of 250 µg/ml. 0, 5 and 25 nM of Human LAG-3 Fc Chimera Protein (R&D Systems, 2319-L3) was applied for 180 s at a flow rate of 30 µl/min. The dissociation phase was monitored for 900 sec by washing with running buffer. The surface was regenerated by injecting H3PO4 (0.85%) for 70 seconds at a flow rate of 30 µl/min.

Bulk refractive index differences were corrected by subtracting the response obtained from a mock surface. Blank injections were subtracted (double referencing). The derived curves were fitted to a 1:1 Langmuir binding model using the BIAevaluation software. Comparing the measured off-rates with the off-rates of the previously measured monovalent aVHs domains, one can conclude that binding of bivalent aVH-Fc constructs is very strongly avidity-mediated.

Example 8

Characterization of aVH-Fc Fusion Constructs on Cells

In the following section, selected aVH-Fc fusion constructs were characterized in several cell-based assays. For the in vitro experiments described below, the following reagents were used. A summary of all results can be found in Table 15.

Materials used were PBS (DPBS, PAN, P04-36500), BSA (Roche, 10735086001), Tween 20 (Polysorbat 20 (usb, #20605, 500 ml)), PBST blocking buffer (PBS (10×, Roche, #11666789001)/2% BSA (Bovine Serum Albumin Fraction V, fatty acid free, Roche, #10735086001)/0.05% Tween 20), One Step ELISA Buffer (OSEP) (PBS (10×, Roche, #11666789001), 0.5% BSA (Bovine Serum Albumin Fraction V, fatty acid free, Roche, #10735086001), 0.05% Tween 20).

TABLE 15

Cell-based characterization of bivalent aVH-Fc fusion constructs

| | A375 MHCII competiton ELISA | | | Human LAG3 cell ELISA (CHO cells) | | | Cyno LAG3 flow cytometry (HEK cells) | |
|---|---|---|---|---|---|---|---|---|
| clone | % Inhibition | IC50 (ng/ml) | IC50 [nM] | OD max | EC50 (ng/ml) | EC50 (nM) | LAG3 positive cells (%) | Signal intensity (Geo Mean) |
| P11A2 aVH-Fc | 92.4 | 90.3 | 1.2 | 1.2 | 16.9 | 0.2 | | |
| P9G1 aVH-Fc | 96.3 | 40.8 | 0.5 | 1.2 | 17.3 | 0.2 | | |
| 9B4 aVH-Fc | 95.5 | 76.2 | 1.0 | 1.3 | 28.8 | 0.4 | 68.8 | 2059 |
| P10D1 aVH-Fc | 93.4 | 93.3 | 1.2 | 1.2 | 29.0 | 0.4 | | |
| 17D7 aVH-Fc | 91.7 | 104.4 | 1.4 | 1.4 | 35.4 | 0.5 | 63.6 | 1980 |

TABLE 15-continued

Cell-based characterization of bivalent aVH-Fc fusion constructs

| clone | A375 MHCII competiton ELISA | | | Human LAG3 cell ELISA (CHO cells) | | | Cyno LAG3 flow cytometry (HEK cells) | |
|---|---|---|---|---|---|---|---|---|
| | % Inhibition | IC50 (ng/ml) | IC50 [nM] | OD max | EC50 (ng/ml) | EC50 (nM) | LAG3 positive cells (%) | Signal intensity (Geo Mean) |
| P11E9 aVH-Fc | 97.2 | 86.0 | 1.1 | 1.3 | 37.5 | 0.5 | | |
| P21A03 aVH-Fc | 97.4 | 58.1 | 0.8 | 1.2 | 40.1 | 0.5 | | |
| 21B11 aVH-Fc | 96.7 | 112.5 | 1.5 | 1.3 | 42.8 | 0.6 | 78.9 | 2754 |
| P11E2 aVH-Fc | 91.0 | 155.5 | 2.1 | 1.2 | 60.3 | 0.8 | | |
| 19G3 aVH-Fc | 91.9 | 224.3 | 3.0 | 1.3 | 63.6 | 0.8 | 80.3 | 2565 |
| P10C3 aVH-Fc | 84.9 | 242.2 | 3.2 | 1.2 | 73.5 | 1.0 | | |
| MDX 25F7 | 90.4 | 127.2 | 0.8 | 2.06 | X | X | 48.2 | 1561 |

X = plateau not reached

Cell-Surface Lag3 Binding ELISA

25 μl/well of Lag3 cells (recombinant CHO cells expressing Lag3, 10,000 cells/well) were seeded into tissue culture treated 384-well plates (Corning, 3701) and incubated at 37° C. for one or two days. The next day after removal of medium, 25 μl of bivalent anti-Lag3 aVH-Fc constructs (1:3 dilutions in OSEP buffer, starting at a concentration of 6 μg/ml) were added and incubated for 2 h at 4° C. After washing (1×90 μl in PBST) cells were fixed by addition of 30 μl/well glutaraldehyde to a final concentration of 0.05% (Sigma Cat.No: G5882), 10 min at room temperature. After washing (3×90 μl/well with PBST-buffer) 25 μl/well goat anti-Human IgG H+L-HRP conjugate (Jackson, JIR109-036-088) was added in a 1:2000 dilution and incubated at RT for 1 h. After washing (3×90 μl/well with PBST-buffer) 25 μl/well TMB substrate (Roche, 11835033001) was added and incubated for 6-10 min. Measurement took place on a Tecan Safire 2 instrument at 370/492 nm. In summary, all tested molecules bound to CHO cells, which recombinantly express LAG3. Their EC50 values were mostly in the sub-nanomolar range indicating a very strong avidity-mediated binding and confirming the strong binding measured by ELISA (Table 14).

A375 MHCII Competition ELISA

25 μl/well of A375 cells (10,000 cells/well) were seeded into tissue culture treated 384-well plates (Corning, 3701) and incubated at 37° C. overnight. Bivalent anti-Lag3 aVH-Fc constructs were pre-incubated for 1 h with biotinylated-Lag3 (250 ng/ml) in cell culture medium in 1:3 dilutions starting at 3 μg/ml antibody-concentration. After removal of medium from the wells with seeded cells, 25 μl of the aVH-Lag3 pre-incubated mixtures were transferred to the wells and incubated for 2 hrs at 4° C. After washing (1×90 μl in PBST) cells were fixed by addition of 30 μl/well glutaraldehyde to a final concentration of 0.05% (Sigma Cat.No: G5882), 10 min at room temperature. After washing (3×90 μl/well with PBST-buffer) 25 μl/well Poly-HRP40-Streptavidin (Fitzgerald, 65R-S104PHRPx) was added in a 1:2000 or 1:8000 dilution and incubated at RT for 1 h. After washing (3×90 μl/well with PBST-buffer) 25 μl/well TMB substrate (Roche, 11835033001) was added and incubated for 2 to10 min. Measurement took place on a Tecan Safire 2 instrument at 370/492 nm. Compared to the control antibody MDX25F7, several aVH clones showed similar or even better inhibition at a concentration of 3 μg/ml and equivalent IC50 values.

Binding of aVH-Fc Constructs to Recombinant Cyno Lag3 Positive HEK Cells

In addition to the binding analysis using CHO cells recombinantely expressing human LAG3, binding to cynomolgus Lag3-positive HEK cells was also evaluated. For this experiment, frozen HEK293F cells, previously transiently transfected with cyno LAG3, were thawed, centrifuged and resupplemented in PBS/2% FBS. $1.5 \times 10^5$ cells/well were seeded into 96-well plates. A set of bivalent anti-Lag3 aVH-Fc fusion constructs wered added to a final normalized concentration of 10 μg/ml. For referencing and as controls, autofluorescence and positive control (MDX 25F7 and MDX 26H10) as well as isotype control (huIgG1 from Sigma, cat.no. #15154) antibodies were prepared and measured in the experiment. HEK cells were incubated with indicated aVH-Fc constructs or antibodies for 45 min on ice, washed twice with 200 μl ice-cold PBS/2% FBS buffer, before secondary antibody (APC-labelled goat anti-human IgG-kappa, Invitrogen, cat.no. #MH10515) was added (1:50 diluted in FACS-Puffer/well) and further incubated for 30 min on ice. Cells were again washed twice with 200 μl ice-cold PBS/2% FBS buffer before samples were finally resuspended in 150 μl FACS buffer and binding was measured on FACS CANTO-II HTS Module.

Example 9

Generation of a Further Generic Autonomous Human Heavy Chain Variable Domains (aVH) Library Desired gene segments, where required, were either generated by PCR using appropriate templates or were synthesized at Geneart AG (Regensburg, Germany) from synthetic oligonucleotides and PCR products by automated gene synthesis. The gene segments flanked by singular restriction endonuclease cleavage sites were cloned into standard cloning/sequencing vectors. The plasmid DNA was purified from transformed bacteria and concentration determined by UV spectroscopy. The DNA sequence of the sub-cloned gene fragments was confirmed by DNA sequencing. Gene segments were designed with suitable restriction sites to allow sub-cloning into the respective expression vectors. All constructs used for secretion in eukaryotic cells were designed with a 5'-end DNA sequence coding for a leader peptide. SEQ ID NOs 248 and 249 give exemplary leader peptides.

For the selection of specific aVH domains, three different antigens were generated.

Antigen 1: For the generation of a CEACAM5-based antigen that contains its first two domains N and A1, a chimeric protein consisting of 2 CEACAM5 and 2 CEACAM1 Ig domains was generated. Based on the sequence of CEACAM1, the first and second domain of CEACAM1 was replaced by the CEACAM5 domains N and A1. A C-terminal avi-tag and his-tag were fused for site-specific biotinylation and purification. The resulting protein was named hu(NA1)BA-avi-His (SEQ ID NO: 250). In addition, a molecule consisting of the 4 Ig domains of CEACAM1 and a C-terminal avi-tag and his-tag was generated. This molecule served as a tool for negative selection during phage display panning and a control molecule during screening (SEQ ID NO: 255). The term "CEA" is used herein as synonym for the term "CEACAM5".

Antigen 2: A DNA fragment encoding the extracellular domain (amino acids 1 to 134 of matured protein) of human CD28 (Uniprot: P10747) was inserted in frame into two different mammalian recipient vectors upstream of a fragment encoding a hum IgG1 Fc fragment which serves as solubility- and purification tag. One of the expression vectors contained the "hole" mutations in the Fc region, the other one the "knob" mutations as well as a C-terminal avi tag (GLNDIFEAQKIEWHE (SEQ ID NO: 418)) allowing specific biotinylation during co-expression with Bir A biotin ligase. In addition, both Fc fragments contained the PG-LALA mutations. Both vectors were co-transfected in combination with a plasmid coding for the BirA biotin ligase in order to get a dimeric CD28-Fc construct with a monovalent biotinylated avi-tag at the C-terminal and of the Fc-knob chain. (SEQ ID NOs: 251 and 252).

Antigen 3: For the generation of soluble recombinant Prolyl endopeptidase FAP, the respective DNA fragments encoding amino acids 27-760 (human FAP, Uniprot: Q12884, SEQ ID NO: 253) or 27-761 (murine FAP, Uniprot: P97321, SEQ ID NO: 254) were cloned in frame into a mammalian recipient vector containing an N-terminal leader sequence. In addition, the constructs contain a C-terminal avi-tag allowing specific biotinylation during co-expression with Bir A biotin ligase and a his-tag used for purification by immobilized-metal affinity chromatography.

For the further characterization of the selected clones, ELISA-positive aVHs were purified for the exact analysis of the kinetic parameters. For each clone, a 500 ml culture was inoculated with bacteria harboring the corresponding phagemid and induced with 1 mM IPTG at an OD600 0.9. Afterwards, the cultures were incubated at 25° C. overnight and harvested by centrifugation. After incubation of the resuspended pellet for 20 min in 25 ml PPB buffer (30 mM Tris-HCl pH8, 1 mM EDTA, 20% sucrose), bacteria were centrifuged again and the supernatant was harvested. This incubation step was repeated once with 25 ml of a 5 mM MgSO$_4$ solution. The supernatants of both incubation steps were pooled, filtered and loaded on an IMAC column (His gravitrap, GE Healthcare). Subsequently, the column was washed with 40 ml washing buffer (500 mM NaCl, 20 mM Imidazole, 20 mM NaH2PO4 pH 7.4). After the elution (500 mM NaCl, 500 mM Imidazole, 20 mM NaH2PO4 pH 7.4) the eluate was re-buffered using PD10 columns (GE Healthcare) followed by a gel filtration step. The yield of purified protein was in the range of 500 to 2000 µg/l.

In order to further characterize selected aVH clones, binders were converted into an Fc-based format. The DNA of the aVH sequences were N-terminally fused to the sequence encoding a human IgG1 Fc fragment with the "knob" mutations. A glycine-serine linker "GGGGSGGGGS" (SEQ ID NO: 411) separated the C-terminal end of the aVH from the N-terminal end of the Fc-fragment. The aVH-Fc fusion constructs were co-expressed in combination with a plasmid encoding an Fc sequence carrying the "hole" mutation (SEQ ID NO: 259). Both Fc-chains (knob and hole) contained the PG-LALA mutations which completely abolish FcγR binding. The resulting constructs were Fc fragments with an N-terminal monomeric aVH (FIG. 2A). For the expression of CD28-Fc-avi and aVH-Fc constructs, the respective expression constructs were transiently transfected into HEK 293 cells, stably expressing the EBV-derived protein EBNA. If necessary, a simultaneously co-transfected plasmid encoding the biotin ligase BirA allowed avi-tag-specific biotinlylation in vivo. Proteins were purified from filtered cell culture supernatants referring to standard protocols. In brief, Fc-containing proteins were applied to a Protein A Sepharose column (GE healthcare) and washed with PBS. Elution was achieved at pH 2.8 followed by immediate neutralization of the sample. Aggregated protein was separated from the monomeric fraction by size exclusion chromatography (Superdex 200, GE Healthcare) in PBS or in 20 mM Histidine, 150 mM NaCl pH 6.0. Monomeric protein fractions were pooled, concentrated (if required) using e.g., a MILLIPORE Amicon Ultra (30 MWCO) centrifugal concentrator, frozen and stored at −20° C. or −80° C. Part of the samples were provided for subsequent protein analytics and analytical characterization e.g. by SDS-PAGE, size exclusion chromatography (SEC) or mass spectrometry.

Constructs expressing a his-tag were transiently transfected into HEK 293 cells, stably expressing the EBV-derived protein EBNA (HEK EBNA). A simultaneously co-transfected plasmid encoding the biotin ligase BirA allowed avi-tag-specific biotinylation in vivo. Proteins were purified from filtered cell culture supernatants referring to standard protocols using immobilized metal affinity chromatography (IMAC) followed by gel filtration. Monomeric protein fractions were pooled, concentrated (if required), frozen and stored at −20° C. or −80° C. Part of the samples were provided for subsequent protein analytics and analytical characterization e.g. by SDS-PAGE, size exclusion chromatography (SEC) or mass spectrometry.

Biochemical Characterization of the Monovalent aVH-Fc Fusion Constructs

Hydrophobic Interaction Chromatography (HIC)

Apparent hydrophobicity was determined by injecting 20 µg of sample onto a HIC-Ether-5PW (Tosoh) column equilibrated with 25 mM Na-phosphate, 1.5 M ammonium sulfate, pH 7.0. Elution was performed with a linear gradient from 0 to 100% buffer B (25 mM Na-phosphate, pH 7.0) within 60 minutes. Retention times were compared to protein standards with known hydrophobicity. Most antibodies display a relative retention time between 0 and 0.35.

Thermal Stability

Samples were prepared at a concentration of 1 mg/mL in 20 mM Histidine/Histidine chloride, 140 mM NaCl, pH 6.0, transferred into an optical 384-well plate by centrifugation through a 0.4 µm filter plate and covered with paraffine oil. The hydrodynamic radius was measured repeatedly by dynamic light scattering on a DynaPro Plate Reader (Wyatt) while the samples were heated with a rate of 0.05° C./min from 25° C. to 80° C.

FcRn Affinity Chromatography

FcRn was expressed, purified and biotinylated as described (Schlothauer et al.). For coupling, the prepared receptor was added to streptavidin-sepharose (GE Healthcare). The resulting FcRn-sepharose matrix was packed in a column housing. The column was equilibrated with 20 mM 2-(N-morpholine)-ethanesulfonic acid (MES), 140 mM NaCl, pH 5.5 (eluent A) at a 0.5 ml/min flow rate. 30 µg of antibody samples were diluted at a volume ratio of 1:1 with eluent A and applied to the FcRn column. The column was washed with 5 column volumes of eluent A followed by elution with a linear gradient from 20 to 100% 20 mM Tris/HCl, 140 mM NaCl, pH 8.8 (eluent B) in 35 column volumes. The analysis was performed with a column oven at 25° C. The elution profile was monitored by continuous measurement of the absorbance at 280 nm. Retention times were compared to protein standards with known affinities. Most antibodies display a relative retention time between 0 and 1.

Heparin Affinity Chromatography

Heparin affinity was determined by injecting 30-50 µg of sample onto a TSKgel Heparin-5PW (Tosoh) column equilibrated with 50 mM Tris, pH 7.4. Elution was performed with a linear gradient from 0 to 100% buffer B (50 mM Tris, 1M NaCl, pH 7.4 mM) within 37 minutes. Retention times were compared to protein standards with known affinities.

Example 10

Identification of aVH-Satbilizing Mutations and Generation of Stabilized aVH Libraries Despite the introduction of specific mutations in the former VH-VL interface, some of the previously reported aVH molecules were still of reduced thermal stability and showed increased hydrophobicity. In order to further stabilize the aVH framework and increase the hydrophilicity of the domain, exposed hydrophobic amino acids or residues that are conserved in VHH domains of camelids were identified and replaced by hydrophilic residues or the camelid consensus residue. For the introduction of these mutations, an aVH domain (clone 6H1) was chosen that has unfavorable biochemical properties in order to show whether the mutations improve the biochemical properties. 6H1 comprises cysteins in position 52a and 71 (Kabat numbering). Particularly, the cysteins are capable of forming a disulfide bond and/or form a disulfide bond under suitable conditions. The mutations were introduced individually or in combination (FIG. 6). Table 16 summarizes the positions and the rationale for the mutations. Of note, given that the Kabat numbering of the preceding position 101 varies with the length of the CDR3 region, this position was, for simplification, defined as position "101-1".

TABLE 16

Identified exposed positions or residues that are conserved in VHH domains of camelids that were mutated for the improvement of the aVH framework.

| Template amino acid | Tested as single mutations | 6H1 - combo | Rationale for mutation |
| --- | --- | --- | --- |
| V5 | Q | Q | Increase hydrophilicity; Camelids often have Q. |
| L11 | S | S | Increase hydrophilicity; can be exposed. |
| F27 | Y | Y | Human VH1b consensus: Y |

TABLE 16-continued

Identified exposed positions or residues that are conserved in VHH domains of camelids that were mutated for the improvement of the aVH framework.

| Template amino acid | Tested as single mutations | 6H1 - combo | Rationale for mutation |
| --- | --- | --- | --- |
| R39 | Q | Q | Camel consensus: Q. Buried in Fab; (VH/VL Interface), but exposed in aVH |
| G44 | E | E | Camel consensus: E. Buried in Fab; (VH/VL Interface), but exposed in aVH |
| T45 | E/R | T | Camel consensus: R. Mutated to E in Barthelemy et al. Buried in Fab; (VH/VL Interface), but exposed in aVH |
| R58 | Y | Y | Camel consensus: Y, Human VH3: often Y. exposed in both aVH and Fab |
| A84 | P/S | S | Camel consensus: P. Human VH1: S. Exposed in both aVH and Fab |
| V89 | T | T | Increase hydrophilicity. Buried in Fab; (VH/VL Interface), but exposed in aVH |
| F(101-1) | Y | Y | Increase hydrophilicity. Buried in Fab; (VH/VL Interface), but partially exposed in aVH |
| A101 | D | D | Increase hydrophilicity. Camel and most human (J-elements): D. mostly Buried in Fab; (VH/VL Interface), but exposed in aVH |
| T108 | Q | Q | Increase hydrophilicity. Humans: T, L, or Q. Camels: Q. |

In order to characterize and compare their biochemical and biophysical properties, all variants were converted into monovalent aVH-Fc fusion constructs (SEQ ID Nos: 376-390), coexpressed with an Fc-hole chain (SEQ ID NO: 259), and analyzed in detail. The resulting constructs were Fc fragments with an N-terminal monomeric aVH (FIG. 6).

In order to characterize and compare their biochemical and biophysical properties, all monovalent aVH-Fc fusion variants containing the above-described stabilizing mutations were analyzed in detail, according to protocols described herein. The results are summarized in Table 17.

TABLE 17

Biochemical analysis of aVH variants containing framework-stabilizing mutations.

| Clone variant | Thermal stability (DLS $T_{agg}$) (° C.) | Main oligomeric state | Apparent hydrophobicity (HIC) 0 < rel. ret. Time < 1 |
| --- | --- | --- | --- |
| Template(6H1) | 74 | Dimer | 1.15 |
| 6H1_V5Q | 74 | Dimer | 1.14 |
| 6H1_L11S | 74 | Dimer | 1.19 |
| 6H1_F27Y | 74 | Dimer | 1.05 |
| 6H1_R39Q | 74 | Dimer | 1.32 |
| 6H1_G44E | 74 | Monomer | 1.2 |
| 6H1_T45E | 74 | Monomer | 0.93 |
| 6H1_T45R | 74 | Monomer | 0.82 |
| 6H1_R58Y | 74 | Dimer | 1.56 |
| 6H1_A84P | 74 | Dimer | 1.13 |
| 6H1_A84S | 74 | Dimer | 1.18 |
| 6H1_V89T | 74 | Dimer | 1.17 |
| 6H1_F(101-1)99Y | 74 | Monomer | 1.16 |
| 6H1_A101D | 74 | Monomer | 0.7 |
| 6H1_T108Q | 74 | Dimer | 1.11 |
| 6H1_combo | 74 | Larger aggregates | N/A |

In summary, all clones exceed the required aggregation temperature of 58° C. In contrast to the parental sequences variant, several mutations resulted in a monomeric oligomeric state: While the parental clone 6H1 had an intrinsic propensity to form homodimers and was found to have an increased hydrophobic surface, several single mutations were found to improve both criteria. In particular, mutations G44E, T45E, T45R, F(101-1)Y, and A101D improved the biochemical properties of the parental clone 6H1.

Introduction of Combinations of Mutations into Previously Characterized aVH Binders In order to test if the identified mutations that were shown to improve the biochemical properties of clone 6H1 are also beneficial for other aVHs, 3 aVHs (clone 9B4 (SEQ ID NO: 391), clone 17B5 (SEQ ID NO: 396), clone 20G3 (SEQ ID NO: 401)) with different biochemical properties were selected and 4 combinations of mutations were inserted in each parental sequence (Table 18). 9B4, 17B5 and 20G3 each comprise cysteins in positions 33 and 52 (Kabat numbering), which are capable of forming a disulfide bond and/or form a disulfide bond under suitable conditions.

TABLE 18

Biochemical analysis of 3 parental aVH clones and their aVH framework-stabilizing mutations.

| Clone variant | mutations | SEC HMW content (%) | Apparent hydro-phobicity (HIC) rel. ret. <0.35 | FcRn chroma-tography 0 < rel. ret. Time < 1 |
|---|---|---|---|---|
| 9B4 | | 0.6 | 0.28 | 1.01 |
| 9B4 | A94K/E101D | 2.1 | 0.25 | 0.93 |
| 9B4 | G44E/T45E/F(101-1)Y | 0.9 | 0.19 | 0.86 |
| 9B4 | G44E/T45E/L47T/F(101-1)Y | 0.8 | 0.19 | 0.77 |
| 9B4 | G44E/T45R/F(101-1)Y | 0.8 | 0.18 | 0.79 |
| 17B5 | | 5.8 | 0.42 | 1.59 |
| 17B5 var1 | D94K/E101D | 7.3 | 0.30 | 0.97 |
| 17B5 var2 | G44E/T45E/F(101-1)Y | 1.5 | 0.31 | 0.81 |
| 17B5 var3 | G44E/T45E/L47T/F(101-1)Y | 8.7 | 0.30 | 0.82 |
| 17B5 var4 | G44E/T45R/F(101-1)Y | 1.8 | 0.37 | 0.97 |
| 20G3 | | 1.8 | 0.51 | 1.51 |
| 20G3 var1 | S94K/S101D | 1.4 | 0.23 | 0.84 |
| 20G3 var2 | G44E/T45E/F(101-1)Y/S101D | 0.8 | 0.23 | 0.80 |
| 20G3 var3 | G44E/T45E/L47T/F(101-1)Y/S101D | 0.3 | 0.24 | 0.80 |
| 20G3 var4 | G44E/T45R/F(101-1)Y/S101D | 0.3 | 0.23 | 0.92 |

The resulting clone variants were then produced and purified as monomeric aVH-Fc fusion constructs and their biochemical properties were analyzed (variant 1-4 of clone 9B4 (SEQ ID Nos: 392-395) variant 1-4 of clone 17B5 (SEQ ID NO: 397-4000) variant 1-4 of clone 20G3 (SEQ ID NO: 402-405)). In some variants, the mutation L47T and 94K were inserted in addition to the herein identified mutations. L47T was introduced merely for stabilization purpose, as e.g. in each of variant 3 described above. 94K was introduced to revert to the germline residue in position 94, as e.g. in each of variant 1 described above.

Comparing the variants with each other as summarized in Table 18, variant 2 that comprises G44E, T45E and F(101-1)Y showed the most favorable biochemical properties in all three clones 9B4, 17B5 and 20G3. Therefore, these mutations were introduced into three new templates that were used for the generation of new aVHs libraries (SEQ ID NOs: 256, 257, 258)

Example 11

New Library Templates for the Generation of Stabilized Generic Autonomous Human Heavy Chain Variable Domain (aVH) Libraries New aVH library templates were designed for the generation of aVH libraries with higher stability. The following modifications were made in all template sequences in order to further stabilize the previous templates: introduction of the mutation G44E, T45E, and F(101-1)Y. The resulting proteins sequences (SEQ ID NOs: 256, 257, 258) and the positions for randomization are shown in FIGS. 7A and B.

Generation of new generic autonomous human heavy chain variable domain (aVH) libraries harboring the stabilizing cysteins forming a disulfide bond in positions 52a/71.

For the generation of new aVH libraries, three new templates were designed (SEQ ID NOs: 256, 257, 258). The new templates were named "Phagemid template_G44E_T45E_F(100-1)Y_Y33C_Y52C", "Phagemid template_G44E_T45E_F(100-1)Y_P52aC_A71C_S31ab", and "Phagemid template_G44E_T45E_F(100-1)Y_P52aC_A71C_G26S".

All new libraries were randomized in CDR2 and CDR3. For all 3 libraries, 3 fragments were assembled by "splicing by overlapping extension" (SOE) PCR. Fragment 1 comprises the 5' end of the aVH gene including framework1, CDR1, and parts of framework 2. Fragment 2 overlaps with fragment 1 in framework 2 and encodes CDR2 and the framework 3 region. Fragment 3 anneals with fragment 2 and harbors the CDR3 region and the C-terminal end of the aVH.

For the generation of the first fragment, the following primer combination was used: LMB3 (SEQ ID NO: 374) and H2_Reverse constant primer (SEQ ID NO: 368). For the generation of the second fragment, the following primer combinations were used: For library based on the template "Phagemid template_G44E_T45E_F (100-1) Y_Y33C_Y52C", aVH_H2_forward Primer (Y33C/Y52C) (SEQ ID NO: 406) and aVH_H3 reverse Primer (constant) (SEQ ID NO: 372) were used. For the generation of the second fragment of the libraries based on the template "Phagemid template_G44E_T45E_F (100-1) Y_P52aC_A71C_S31ab" and "Phagemid template_G44E_T45E_F (100-1) Y_P52aC_A71C_G26S", the Primers named "aVH_H2_forward Primer (P52aC/A71C)" (SEQ ID NO: 407) and "aVH_H3 reverse Primer (constant)" (SEQ ID NO: 372) were used. For the generation of the third fragment, the primers named "aVH_H3_5_for_Primer_TN", "aVH_H3_6_for_Primer_TN", and "aVH_H3 7_for_Primer_TN" (SEQ ID NOS 408-410) were individually used in combination with the primer "fdseqlong" (SEQ ID NO: 373). A summary of the primer combinations is shown in Table 19 and 20.

TABLE 19

Primer combinations for the generation of new stabilized aVH libraries randomized in CDR2 and 3 (Phagemid templates G44E_T45E_F(100-1)Y_P52aC_A71C_G26S, SEQ ID NO: 256 and G44E_T45E_F(100-1)Y_P52aC_A71C_S31ab SEQ ID NO: 257). CDR2 and3-randomized library based on templates of SEQ ID NOs: 256, 257

| fragment | 5'Primer | 3'Primer |
|---|---|---|
| PCR1 | LMB3 | aVH H2 reverse constant primer |

TABLE 19-continued

Primer combinations for the generation of
new stabilized aVH libraries randomized
in CDR2 and 3 (Phagemid templates
G44E_T45E_F(100-1)Y_P52aC_A71C_G26S, SEQ ID NO:
256 and G44E_T45E_F(100-1)Y_P52aC_A71C_S31ab
SEQ ID NO: 257).
CDR2 and3-randomized library based on
templates of SEQ ID NOs: 256, 257

| fragment | 5'Primer | 3'Primer |
|---|---|---|
| PCR2 | aVH_H2_forward Primer (P52aC/A71C) | aVH H3 reverse constant primer |
| PCR3 | aVH_H3_5_for_Primer_TN aVH_H3_6_for_Primer_TN aVH_H3_7_for_Primer_TN | fdseqlong |

TABLE 20

Primer combinations for the generation of
new stabilized aVH libraries randomized in
CDR2 and 3 (Phagemid
template_G44E_T45E_F(100-1)Y_Y33C_Y52C,
SEQ ID NO: 258).
CDR2 and3-randomized library based on
template SEQ ID NO: 258

| fragment | 5'Primer | 3'Primer |
|---|---|---|
| PCR1 | LMB3 | aVH H2 reverse constant primer |
| PCR2 | aVH_H2_forward Primer (Y33C/Y52C) | aVH H3 reverse constant primer |
| PCR3 | aVH_H3_5_for_Primer_TN aVH_H3_6_for_Primer_TN aVH_H3_7_for_Primer_TN | fdseqlong |

After assembly of sufficient amounts of full length randomized aVH fragments, they were digested with NcoI/NotI alongside with similarly treated acceptor phagemid vector. 6 µg of aVH library insert were ligated with 24 µg of phagemid vector. Purified ligations were used for 20 transformations resulting in 2-5×10 exp9 to 10 exp10 transformants. Phagemid particles displaying the aVH library were rescued and purified by PEG/NaCl purification to be used for selections.

Example 11

Selection of Anti-FAP from Generic aVH Libraries

In order to test the quality of the new libraries and to further characterize the resulting binders, proof of concept selections against recombinant human and/or murine FAP were performed in solution as described before. Selections were carried out over 4 rounds using decreasing (from $10^{-7}$ M to ×$10^{-8}$ M) antigen concentrations and increasing washing steps. Selection of all three libraries was performed either against human or murine FAP or against both antigens in an alternating way. In that case, the first and third panning round was against human FAP, the second and third round against murine FAP.

In all rounds and streamlines, phage particles were eluted by addition of 1 ml 100 mM triethylamine (TEA) for 10 min followed by neutralization with 500 µl 1M Tris/HCl pH 7.4. Eluted phage was used for re-infection of exponentially growing E. coli TG1 bacteria. Subsequently, bacteria were infected with helper phage VCSM13 and cultured overnight. The next day, phagemid particles were harvested by PEG/NaCl precipitation and used in subsequent selection rounds.

Specific binders were identified applying a mix-and-read assays that was measured with the plate cytometer Mirrorball (TTP Labtech) as follows: For each 384-well plate, 10 µl of Sol-R2 and Sol-R4 Streptavidin beads (TTP labtech kit) were washed individually twice with PBS and resuspended in 1 ml PBS. Biotinylated FAP-avi-His was added to the Sol-R2-containing solution to a final concentration of 80 nM. An unrelated biotinylated protein was added at the same concentration to Sol-R4 beads. After 1 h at RT, beads were again washed with PBS in order to remove unbound protein. Both types of beads were resuspended in 8 ml PBS and pooled. In a next step, a secondary FITC-labeled anti-FLAG tag antibody was added to a final concentration of 800 ng/ml and 35 µl/well of this final mixture was pipetted on a 384-well plate. After the addition of individual aVH-containing bacterial supernatant (5 µl) to each well, the plate was incubated overnight, in the dark at 4 degrees. The next day, the fluorescent signal of each well was measured for both types of beads. Clones exhibiting significant signals over background were short-listed for sequencing and further analyses (SEQ ID Nos: 260-279).

Clones that were identified in the "mix-and-read assay" performed with the Mirrorball instrument were further analyzed by Surface Plasmon Resonance (SPR). The off-rate of selected aVH clones was measured using a ProteOn XPR36 instrument (Biorad) at 25° C. with biotinylated human and murine FAP antigen immobilized on NLC chips by neutravidin capture. Immobilization of recombinant antigens (ligand): Antigens were diluted with PBST (10 mM phosphate, 150 mM sodium chloride pH 7.4, 0.005% Tween 20) to 10 µg/ml, then injected at 30 µl/minute at varying contact times, to achieve immobilization levels of 400, 800 or 1600 response units (RU) in vertical orientation. Injection of analytes: Injection direction was changed to horizontal orientation and 5 individual aVH-containing supernatants that were diluted 1:3 with PBST were injected simultaneously at 60 µl/min along separate channels 1-5, with association times between 120 and 180 s, and dissociation times of 600 s. Diluted bacterial supernatant without aVH was injected along the sixth channel to provide an "in-line" blank for referencing. Dissociation rate constants (koff) were calculated using the "koff-rate" calculation in ProteOn Manager v3.1 software. In table 21, measured koff values of the best clones are summarized.

TABLE 21

Off-rates of FAP-specific aVHs measured
with bacterial supernatant by SPR.

| clone | huFAP k off (1/s) | mu FAP k off (1/s) |
|---|---|---|
| P011.064 | N/A (bad fitting) | no binding |
| P011.080 | N/A (bad fitting) | no binding |
| P012.090 | N/A (bad fitting) | no binding |
| P014.087 | N/A (bad fitting) | no binding |
| P031.033 | no binding | 1.06E−02 |
| P031.078 | no binding | 7.60E−03 |
| P032.056 | no binding | 2.22E−02 |
| P034.001 | no binding | 1.76E−02 |
| P034.007 | 3.85E−03 | 1.06E−02 |
| P034.066 | 2.15E−04 | 2.53E−03 |
| P034.090 | 1.07E−03 | 2.55E−02 |
| P046.052 | no binding | 2.14E−03 |
| P047.001 | 5.42E−03 | 1.57E−02 |
| P048.019 | 5.47E−03 | 1.71E−02 |
| P049.004 | 5.08E−03 | 2.07E−03 |
| P053.020 | 1.25E−02 | 2.94E−02 |

TABLE 21-continued

Off-rates of FAP-specific aVHs measured
with bacterial supernatant by SPR.

| clone | huFAP k off (1/s) | mu FAP k off (1/s) |
|---|---|---|
| P054.035 | 1.41E−02 | 1.51E−02 |
| P054.064 | 1.61E−02 | 3.12E−02 |
| P058.068 | 3.16E−03 | no binding |
| P060.092 | no binding | 7.44E−03 |

Affinity (KD) of 4 selected purified aVH clones was measured by surface plasmon resonance using a ProteOn XPR36 instrument (Biorad) at 25° C. with biotinylated FAP antigen immobilized on NLC chips by neutravidin capture. Immobilization of recombinant antigens (ligand): Antigen was diluted with PBST (10 mM phosphate, 150 mM sodium chloride pH 7.4, 0.005% Tween 20) to 10 µg/ml, then injected at 30 µl/minute at varying contact times, to achieve immobilization levels of 200, 400 or 800 response units (RU) in vertical orientation. Injection of analytes: For one-shot kinetics measurements, injection direction was changed to horizontal orientation, two-fold dilution series of purified aVH (varying concentration ranges between 200 and 6.25 nM) were injected simultaneously at 60 µl/min along separate channels 1-5, with association times between 120 and 180 s, and dissociation times of 1200 s. Buffer (PBST) was injected along the sixth channel to provide an "in-line" blank for referencing. Association rate constants ($k_{on}$) and dissociation rate constants ($k_{off}$) were calculated using a simple one-to-one Langmuir binding model in ProteOn Manager v3.1 software by simultaneously fitting the association and dissociation sensorgrams. The equilibrium dissociation constant (KD) was calculated as the ratio $k_{off}/k_{on}$. Analyzed clones revealed KD values in the single or low digit nanomolar range (Table 22).

TABLE 22

Determination of kinetic and thermodynamic parameters
of selected purified FAP-specific aVHs by SPR.

| Clone ID | Library template | Ag | $k_{on}$ (1/Ms) | $k_{off}$ (1/s) | $K_D$ (M) |
|---|---|---|---|---|---|
| P046.052 | SEQ ID NO: 257 | muFAP | $4.3 \times 10^5$ | $9.3 \times 10^{-3}$ | $2.1 \times 10^{-9}$ |
| P049.004 | SEQ ID NO: 256 | muFAP | $5.1 \times 10^4$ | $1.02 \times 10^{-3}$ | $2.3 \times 10^{-8}$ |
| P047.001 | SEQ ID NO: 258 | muFAP | $3.2 \times 10^5$ | $7.84 \times 10^{-3}$ | $2.45 \times 10^{-8}$ |
|  |  | huFAP | $1.15 \times 10^6$ | $1.33 \times 10^{-3}$ | $1.15 \times 10^{-9}$ |
| P034.090 | SEQ ID NO: 258 | huFAP | $5.52 \times 10^5$ | $4.6 \times 10^{-4}$ | $8.46 \times 10^{-10}$ |

Figure 8:
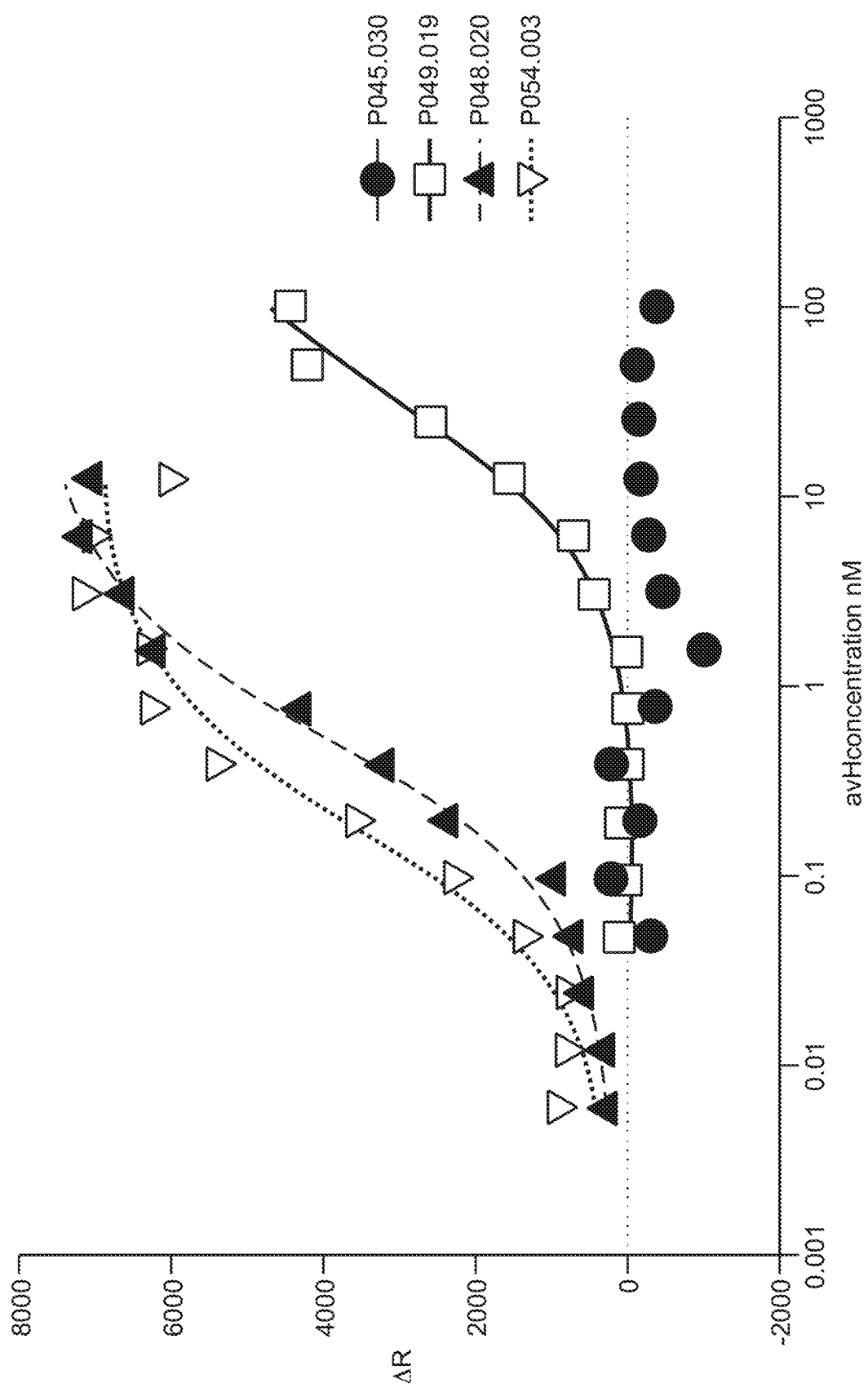
FIG. 8: FRET analysis of FAP-specific aVH clones. FRET analysis on transiently transfected cells expressing a transmembrane hu FAP-SNAP tag fusion protein labeled with terbium. Analysis was done by adding aVHs at a concentration ranging from 0.005 up to 100 nM followed by the addition of a d2-labeled anti-his tag antibody (final 200 nM per well) as acceptor molecule. Specific FRET signal was measured after 3 h and KD values were calculated.

Binding of a selected set of purified aVH binders to their epitope on FAP-expressing cells was determined by Fluorescence Resonance Energy Transfer (FRET) analysis. For this analysis, the DNA sequence encoding the SNAP Tag (plasmid purchased from Cisbio) was amplified by PCR and ligated into an expression vector, containing the full length human FAP sequence. The resulting fusion protein was comprised of full-length FAP with a C-terminal SNAP tag. HEK293 cells were transfected with 10 µg DNA using Lipofectamine 2000 as transfection reagent. After an incubation time of 20 h, cells were washed with PBS and incubated for 1 h at 37° C. in LabMed buffer (Cisbio) containing 100 nM SNAP-Lumi4Tb (Cisbio), leading to specific labeling of the SNAP Tag. Subsequently, cells were washed 4 times with LabMed buffer to remove unbound dye. The labeling efficiency was determined by measuring the emission of Terbium at 615 nm compared to buffer. Cells were then stored frozen at −80° C. for up to 6 months. Binding was measured by adding FAP-specific aVH binders at a concentration ranging from 0.005 up to 100 nM to labeled cells (100 cells per well) followed by addition of d2-labeled anti-his tag antibody (Cisbio, final concentration was 200 nM per well) as acceptor molecule for the FRET. After an incubation time of 3 h at RT, the emission of the acceptor dye (665 nm) as well as of the donor dye (615 nm) was determined using a fluorescence Reader (Victor 3, Perkin Elmer). The ratio of acceptor to donor emission was calculated and the ratio of the background control (cells only incubated with anti-his tag antibody) subtracted. Curves were analyzed in GraphPad Prism5 (FIG. 8) and KDs calculated (Table 23).

TABLE 23

Binding analysis of selected hu FAP-specific
aVH binders by TagLite on cells

| Clone ID | Kd nM | 95% Confidence Intervale (nM) |
|---|---|---|
| P045.030 | No binding |  |
| P049.019 | 37 | 20 to 53 |
| P048.020 | 0.5 | 0.37 to 0.59 |
| P054.003 | 0.17 | 0.10 to 0.24 |

In order to characterize and compare their biochemical and biophysical properties, all binders were converted into monovalent aVH-Fc fusion constructs (SEQ ID Nos: 280-299), coexpressed with an Fc-hole chain (SEQ ID NO: 259), purified, and analyzed in detail. The resulting constructs were Fc domains with an N-terminal monomeric aVH (FIG. 2A).

In order to characterize and compare their biochemical and biophysical properties, all monovalent aVH-Fc fusion constructs were analyzed in detail. The results are summarized in Table 24.

TABLE 24

Biophysical and biochemical properties
of different tested molecules.

| monovalent anti-FAP aVH-Fc | Thermal stability (DLS $T_{agg}$/DLS $T_m$) >58° C. | Apparent hydrophobicity (HIC) rel. ret. <0.35 (<Avastin) | Heparin affinity chromatography 0 < rel. ret. Time < 0.8 |
|---|---|---|---|
| P011.064 | 64 | 0.22 | 1.00 |
| P011.080 | 64 | 0.08 | 0.56 |
| P012.090 | 61 | 0.10 | 1.09 |
| P014.087 | 59 | 0.46 | 0.25 |
| P031.033 | 64 | 0.07 | 0.32 |
| P031.078 | 61 | 0.26 | 0.44 |
| P032.056 | 62 | 0.17 | 0.70 |
| P034.001 | 64 | 0.04 | 0.73 |
| P034.007 | 59 | 0.46 | 0.24 |

TABLE 24-continued

Biophysical and biochemical properties of different tested molecules.

| monovalent anti-FAP aVH-Fc | Thermal stability (DLS $T_{agg}$ /DLS $T_m$) >58° C. | Apparent hydrophobicity (HIC) rel. ret. <0.35 (<Avastin) | Heparin affinity chromatography 0 < rel. ret. Time < 0.8 |
|---|---|---|---|
| P034.066 | 65 | 0.18 | 0.27 |
| P034.090 | 58 | 0.49 | 0.24 |
| P046.052 | 64 | 0.36 | 0.64 |
| P048.019 | 65 | 0.07 | 0.65 |
| P049.004 | 60 | 0.23 | 0.64 |
| P053.020 | 61 | 0.24 | 0.39 |
| P054.035 | 61 | 0.32 | 0.30 |
| P054.064 | 63 | 0.34 | 0.24 |
| P058.068 | 62 | 0.07 | 0.41 |
| P060.092 | 63 | 0.22 | 0.72 |

In summary, all clones match or exceed the required aggregation temperature of 58° C. and the majority of clones demonstrated acceptable properties regarding hydrophobicity and interaction with Heparin.

Example 12

Selection and Characterization of Anti-CEA-Specific aVHs Binders from Generic aVH Libraries Selections against the N- and A1-domain of CEA using the biotinylated antigen "hu(NA1)BA-avi-His" were performed in solution as described before. For all selections and libraries, a pre-clearing step with 200 nM biotinylated hu CEACAM1 (coated on a neutravidin plate) was first performed in order to avoid binders against the CEACAM1-derived domains of the chimeric antigen hu(NA1)BA-avi-His. Afterwards, the libraries were individually selected for specific binders against the CEACAM5 antigen. Selections were carried out over 4 rounds using decreasing (from $10^{-7}$ M to $2 \times 10^{-8}$ M) antigen concentrations and increasing washing steps. Alternatively, the panning rounds 3 and 4 were performed on CHO-K1 cells stably transfected with full-length hu CEA. In that case, libraries were incubated with 10 million CEA-negative CHO cells for depletion of unspecific aVH binders for 60 min at 4° C. using a gently rotating tube rotator. After this step, CHO cells were pelleted. The supernatants containing the phage libraries were harvested and incubated with 5 million CEA-expressing CHO cells at 4° C. After 60 minutes, cells were washed 5 times with PBS before phage particles were eluted. In all rounds and streamlines, phage particles were eluted with two alternative procedures: 1) addition of 1 ml 100 mM triethylamine (TEA) for 10 min followed by neutralization with 500 µl 1M Tris/HCl pH 7.4, or 2) elution by competition using a CEA-specific antibody (200 nM) that is incubated for 30 min with antigen:phage complexes. Eluted phage was used for re-infection of exponentially growing E. coli TG1 bacteria. Next, bacteria were infected with helper phage VCSM13 and cultured o.n. The next day, phagemid particles were harvested by PEG/NaCl precipitation and used in subsequent selection rounds.

Specific binders were identified applying a mix-and-read assays that was measured with the plate cytometer Mirrorball (TTP Labtech) as follows: For each 384-well plate, 10 µl of Sol-R2 and Sol-R4 Streptavidin beads (TTP labtech kit) were washed individually twice with PBS and resuspended in 1 ml PBS. Biotinylated hu(NA1)BA-avi-His was added to the Sol-R2-containing solution to a final concentration of 80 nM. Biotinylated CEACAM1-avi-his was added at the same concentration to Sol-R4 beads and was used as a negative control. After 1 h at RT, beads were again washed with PBS in order to remove unbound protein. Both types of beads were re-suspended in 8 ml PBS and pooled. In a next step, a secondary FITC-labeled anti-FLAG tag antibody was added to a final concentration of 800 ng/ml and 35 µl/well of this final mixture was pipetted on a 384-well plate. After the addition of individual aVH-containing bacterial supernatant (5 µl) to each well, the plate was incubated o.n. in the dark at 4 degrees. The next day, the fluorescent signal of each well was measured for both types of beads. Clones exhibiting significant signals over background were short-listed for sequencing and further analyses (SEQ ID Nos: 300-313).

Clones that were identified in the "mix-and-read assay" performed with the Mirrorball instrument were further analyzed by Surface Plasmon Resonance (SPR). The off-rate of selected aVH clones was measured using a ProteOn XPR36 instrument (Biorad) at 25° C. with biotinylated hu(NA1) BA-avi-His immobilized on NLC chips by neutravidin capture. CEACAM1-avi-his was used as a negative control. Immobilization of recombinant antigens (ligand): Antigens were diluted with PBST (10 mM phosphate, 150 mM sodium chloride pH 7.4, 0.005% Tween 20) to 10 µg/ml, then injected at 30 µl/minute at varying contact times, to achieve immobilization levels of 400, 800 or 1600 response units (RU) in vertical orientation. Injection of analytes: Injection direction was changed to horizontal orientation and 5 individual aVH-containing supernatants that were diluted 1:3 with PBST were injected simultaneously at 60 µl/min along separate channels 1-5, with association times between 120 and 180 s, and dissociation times of 800 s. Diluted bacterial supernatant without aVH was injected along the sixth channel to provide an "in-line" blank for referencing. Dissociation rate constants (kw) were calculated using the "koff-rate" calculation in ProteOn Manager v3.1 software. (Table 25)

TABLE 25

Determination of the $k_{off}$ rates of the CEA-specific aVH clones from bacterial supernatant by SPR.

| Clone ID | k off (1/s) |
|---|---|
| P112.068 | 1.60E-03 |
| P112.083 | 3.40E-04 |
| P118.008 | 3.05E-02 |
| P118.061 | 7.70E-03 |
| P118.089 | 5.99E-02 |
| P118.093 | 3.30E-02 |
| P123.065 | 2.78E-02 |
| P124.021 | 1.75E-02 |
| P124.034 | 1.87E-02 |
| P124.037 | 3.95E-02 |
| P124.067 | 7.04E-03 |
| P127.002 | 2.64E-02 |
| P127.014 | 6.02E-03 |
| P127.141 | 3.17E-02 |

Affinity (KD) of selected purified aVH clones was measured by surface plasmon resonance using a ProteOn XPR36 instrument (Biorad) at 25° C. with biotinylated hu(NA1) BA-avi-His antigen immobilized on NLC chips by neutravidin capture. CEACAM1-avi-his was used as a negative control Immobilization of recombinant antigens (ligand): Antigen was diluted with PBST (10 mM phosphate, 150 mM sodium chloride pH 7.4, 0.005% Tween 20) to 10 µg/ml, then injected at 30 µl/minute at varying contact times, to achieve immobilization levels of 200, 400 or 800 response units (RU) in vertical orientation. Injection of analytes: For one-shot kinetics measurements, injection direction was changed to horizontal orientation, two-fold dilution series of purified aVH (varying concentration ranges between 200 and 6.25 nM) were injected simultaneously at 60 µl/min along separate channels 1-5, with association times between 120 and 180 s, and dissociation times of 800. Buffer (PBST) was injected along the sixth channel to provide an "in-line" blank for referencing. Association rate constants ($k_{on}$) and dissociation rate constants ($k_{off}$) were calculated using a simple one-to-one Langmuir binding model in ProteOn Manager v3.1 software by simultaneously fitting the association and dissociation sensorgrams. The equilibrium dissociation constant (KD) was calculated as the ratio kodkon. Analyzed clones revealed KD values in a very broad range (between 7 and 144 nM) (Table 26).

TABLE 26

Determination of the Affinity of purified CEA-specific aVH clones by SPR and by TagLite.

| Clone ID | Affinity by SPR (nM) | Affinity by TagLite (nM) |
|---|---|---|
| P112.068 | 16.2 | 14.6 |
| P112.083 | 7.26 | 10.4 |
| P118.008 | 96.2 | 28.6 |
| P118.061 | 53.6 | 14.7 |
| P118.089 | 37.9 | 16.8 |
| P118.093 | 102 | 47.3 |
| P123.065 | 89.1 | 190.4 |
| P124.021 | 54.5 | 12.3 |
| P124.034 | 144 | 65.4 |
| P124.037 | 15.2 | 11.1 |
| P127.002 | 246 | 399 |
| P127.141 | 135 | 28.3 |
| P124.067 | 296 | 74.3 |
| P127.014 | 28.3 | 9.1 |

Figure 9:
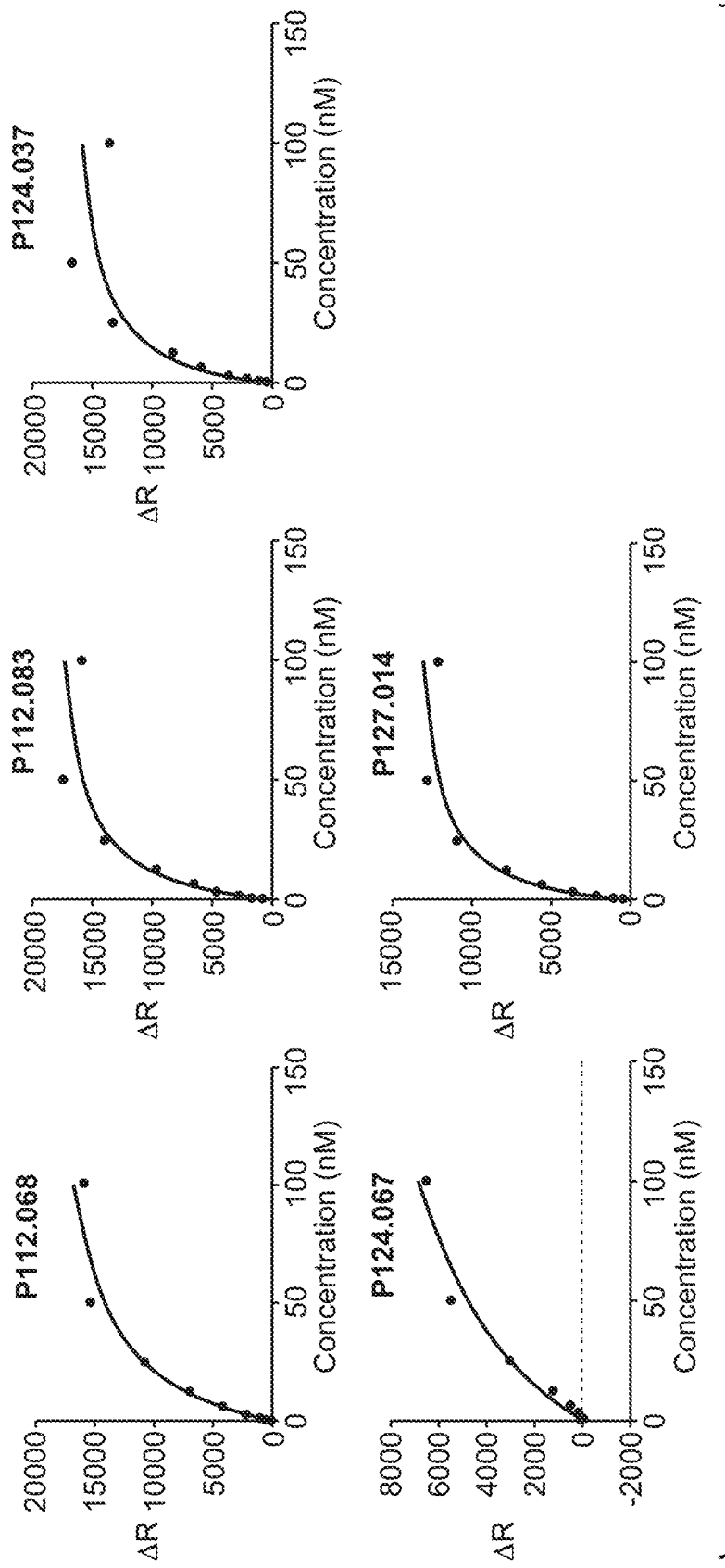
FIG. 9: FRET binding analysis of CEA-specific aVH clones. FRET analysis on transiently transfected cells expressing a transmembrane hu CEA-SNAP tag fusion protein labeled with terbium. Analysis was done by adding aVHs at a concentration ranging from 0.005 up to 100 nM followed by the addition of a d2-labeled anti-his tag antibody (final 200 nM per well) as acceptor molecule. Specific FRET signal was measured after 3 h and KD values were calculated.
Figure 10:
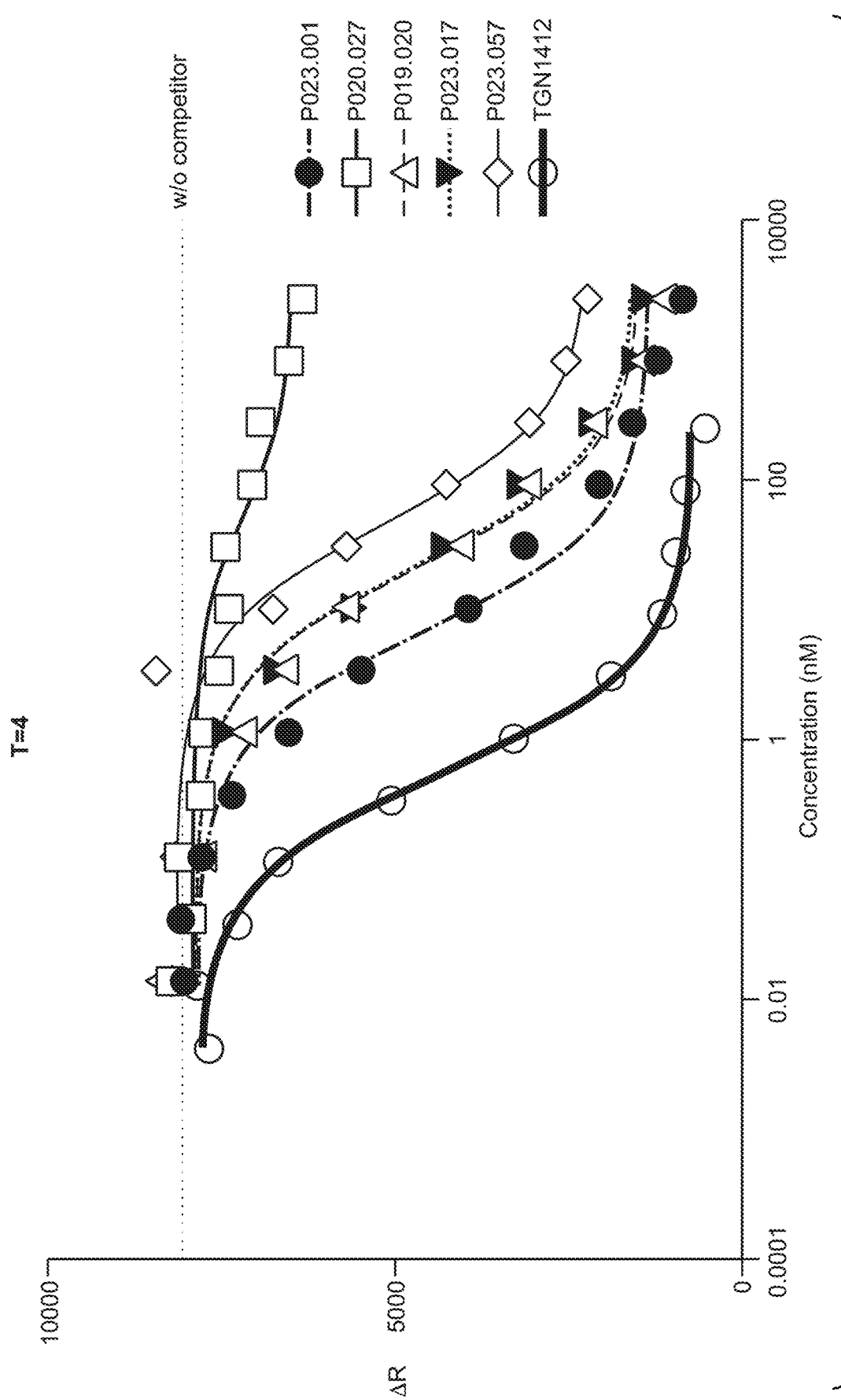
FIG. 10: FRET competition analysis of CD28-specific aVH clones for the identification of TGN1412-competing aVH clones. After the incubation of d2-labeled TGN1412 with transiently transfected cells expressing a transmembrane hu CD28-SNAP tag fusion protein labeled with terbium, purified aVH clones were added to the mix at concentration ranging from 0.014 nM to 2500 nM. Clones that share the same epitope as TGN1412 compete for binding and therefore reduce the FRET signal with increasing concentrations.

Binding of a selected set of purified aVH binders to their epitope on CEA-expressing cells was determined by Fluorescence Resonance Energy Transfer (FRET) analysis. For this analysis, the DNA sequence encoding for the SNAP Tag (plasmid purchased from Cisbio) was amplified by PCR and ligated into an expression vector, containing the full length human CEA sequence. The resulting fusion protein was comprised of full-length CEA with an N-terminal SNAP tag. HEK293 cells were transfected with 10 µg DNA using Lipofectamine 2000 as transfection reagent. After an incubation time of 20 h, cells were washed with PBS and incubated for 1 h at 37° C. in LabMed buffer (Cisbio) containing 100 nM SNAP-Lumi4Tb (Cibsio), leading to specific labeling of the SNAP Tag. Subsequently, cells were washed 4 times with LabMed buffer to remove unbound dye. The labeling efficiency was determined by measuring the emission of Terbium at 615 nm compared to buffer. Cells were then stored frozen at −80° C. for up to 6 months. Binding was measured by adding CEA-specific aVH binders at a concentration ranging from 0.005 up to 100 nM to labeled cells (100 cells per well) followed by addition of d2-labeled anti-his tag antibody (Cisbio, final concentration was 200 nM per well) as acceptor molecule for the FRET. After an incubation time of 3 h at RT the emission of the acceptor dye (665 nm) as well as of the donor dye (615 nm) was determined using a fluorescence Reader (Victor 3, Perkin Elmer). The ratio of acceptor to donor emission was calculated and the ratio of the background control (cells only incubated with anti-his tag antibody) subtracted. Curves were analysed in GraphPad Prism5 (FIG. 9) and KDs calculated (Table 26). As previously determined by SPR, analyzed clones revealed KD values in a very broad range ranging from 9 to 190 nM.

All binders were converted into monovalent aVH-Fc fusion constructs (SEQ ID Nos: 314-327), coexpressed with an Fc-hole chain (SEQ ID NO: 259) and purified. The resulting constructs were Fc domains with an N-terminal monomeric aVH (FIG. 2A).

Example 13

Selection and Characterization of Anti-CD28-Specific aVHs Binders from Generic aVH Libraries Selections against human CD28 using the biotinylated antigen "hu CD28-Fc" were performed in solution as described before. For all selections and libraries, a pre-clearing step with 300 nM biotinylated hu Fc (coated on a neutravidin plate) was first performed in order to avoid binders against the Fc fragment of the chimeric antigen. Afterwards, the libraries were individually selected for specific binders against the CD28 extracellular domain. Selections were carried out over 4 rounds using decreasing (from $100 \times 10^{-9}$M to $25 \times 10^{-9}$M) antigen concentrations and increasing washing steps.

In all rounds and streamlines, phage particles were eluted with two alternative procedures: 1) addition of 1 ml 100 mM triethylamine (TEA) for 10 min followed by neutralization with 500 µl 1M Tris/HCl pH 7.4, or 2) elution by competition using the superagonistic antibody TGN142 (400 nM) that is incubated for 30 min with antigen:phage complexes. Eluted phage was used for re-infection of exponentially growing E. coli TG1 bacteria. Next, bacteria were infected with helper phage VCSM13 and cultured overnight. The next day, phagemid particles were harvested by PEG/NaCl precipitation and used in subsequent selection rounds.

Specific binders were identified applying a mix-and-read assays that was measured with the plate cytometer Mirrorball (TTP Labtech) as follows: For each 384-well plate, 10 µl of Sol-R2 and Sol-R4 Streptavidin beads (TTP labtech kit) were washed individually twice with PBS and resuspended in 1 ml PBS. Biotinylated huCD28-Fc was added to the Sol-R2-containing solution to a final concentration of 80 nM. A biotinylated unrelated protein was added at the same concentration to Sol-R4 beads and was used as a negative control. After 1 h at RT, beads were again washed with PBS in order to remove unbound protein. Both types of beads were resuspended in 8 ml PBS and pooled. In a next step, a secondary FITC-labeled anti-FLAG tag antibody was added to a final concentration of 800 ng/ml and 35 µl/well of this final mixture was pipetted on a 384-well plate. After the addition of individual aVH-containing bacterial supernatant (5 µl) to each well, the plate was incubated overnight in the dark at 4 degrees. The next day, the fluorescent signal of each well was measured for both types of beads. Clones exhibiting significant signals over background were shortlisted for sequencing and further analyses. (SEQ ID Nos: 328-346).

Clones that were identified in the "mix-and-read assay" performed with the Mirrorball instrument were further analyzed by Surface Plasmon Resonance (SPR). The off-rate of selected aVH clones was measured using a ProteOn XPR36 instrument (Biorad) at 25° C. with biotinylated hu CD28-Fc immobilized on NLC chips by neutravidin capture. A biotinylated Fc fragment was used as a negative control. Immobilization of recombinant antigens (ligand): Antigens were diluted with PBST (10 mM phosphate, 150 mM sodium chloride pH 7.4, 0.005% Tween 20) to 10 µg/ml, then injected at 30 µl/minute at varying contact times, to achieve immobilization levels of 400, 800 or 1600 response units (RU) in vertical orientation. Injection of analytes: Injection direction was changed to horizontal orientation and 5 individual aVH-containing supernatants that were diluted 1:3 with PBST were injected simultaneously at 60 µl/min along separate channels 1-5, with association times between 120 and 180 s, and dissociation times of 800 s. Diluted bacterial supernatant without aVH was injected along the sixth channel to provide an "in-line" blank for referencing. Dissociation rate constants ($k_{off}$) were calculated using the "$k_{off}$-rate" calculation in ProteOn Manager v3.1 software. A summary of the $k_{off}$ rates of those clones that were selected for further anaylsis is shown in Table 27.

TABLE 27

Determination of the $k_{off}$ rates of the CD28-specific aVH clones from bacterial supernatant.

| Clone ID | k off (1/s) |
| --- | --- |
| P019.020 | 2.06E−02 |
| P020.010 | 6.80E−04 |
| P020.017 | 1.09E−02 |
| P020.023 | 3.30E−03 |
| P020.027 | 1.45E−03 |
| P020.029 | 1.51E−03 |
| P020.034 | 2.16E−03 |
| P020.035 | 1.34E−03 |
| P020.037 | 1.31E−02 |
| P020.042 | 1.44E−02 |
| P020.051 | 1.35E−02 |
| P020.057 | 1.74E−02 |
| P020.063 | 1.80E−02 |
| P020.065 | 8.85E−03 |
| P020.077 | 1.17E−02 |
| P023.001 | 3.21E−02 |
| P023.017 | 1.75E−02 |
| P023.039 | 1.76E−02 |
| P023.057 | 7.77E−02 |

In order to characterize and compare their biochemical and biophysical properties, all binder were converted into monovalent aVH-Fc fusion constructs (SEQ ID Nos: 347-365), coexpressed with an Fc-hole chain (SEQ ID NO: 259), and analyzed in detail. The resulting constructs were Fc fragments with an N-terminal monomeric aVH (FIG. 2A). Identification of TGN1412 Epitope-Competing aVHs by SPR In order to identify aVH clones that share the same epitope as TGN1412, a competition analysis was performed by SPR. Biotinylated hu CD28-Fc was diluted with PBST (10 mM phosphate, 150 mM sodium chloride pH 7.4, 0.005% Tween 20) to 10 µg/ml, then injected at 30 µl/minute at varying contact times, to achieve immobilization levels of 800 response units (RU) in vertical orientation. Injection direction was then changed to horizontal orientation and 200 nM TGN1412 IgG was injected along channel 2 until binding saturation was achieved (180 s). Immediately after this step, aVHs-Fc clones were injected along channel 1 (without previous injection of TGN1412) and channel 2 (with previous injection of TGN1412) with an association time of 240 s, and dissociation times of 800 s. PBS without any protein was injected along the sixth channel to provide an "in-line" blank for referencing. 4 clones (clones P023.001, P019.020, P023.017, and P023.057) show binding in channel 1 but not channel 2. This experiment demonstrates that these binders share the same epitope as TGN1412 and therefore cannot bind to hu CD28 in the presence of previously bound TGN1412.

Fluorescence Resonance Energy Transfer Assay of TGN1412 Epitope-Competing aVHs

In order to confirm that clones P023.001, P019.020, P023.017, and P023.057 share the same epitope as TGN1412, a competition experiment on hu CD28-overexpressing cells was performed. For this analysis, the DNA sequence encoding for the SNAP Tag (plasmid purchased from Cisbio) was amplified by PCR and ligated into an expression vector, containing the full length human CD28 sequence. The resulting fusion protein was comprised of full-length CD28 with an N-terminal SNAP tag. Hek293 cells were transfected with 10 ug DNA using Lipofectamine 2000 as transfection reagent. After an incubation time of 20 h, cells were washed with PBS and incubated for 1 h at 37° C. in LabMed buffer (Cisbio) containing 100 nM SNAP-Lumi4Tb (Cibsio), leading to specific labeling of the SNAP Tag. Subsequently, cells were washed 4 times with LabMed buffer to remove unbound dye. The labeling efficiency was determined by measuring the emission of Terbium at 615 nm compared to buffer. Cells were then stored frozen at −80° C. for up to 6 months.

In a first step, d2-labelled TGN1412 (0.15 nM final concentration) was incubated with Terbium-labeled CD28-SNAP tag-overexpressing cells for 1 h. After this incubation, aVH-Fc fusion constructs were added at a concentration ranging from 2500 nM to 0.014 nM (3-fold serial dilution). As a positive control, unlabeled TGN1412 IgG was added at a concentration ranging from 250 nM to 0.0014 nM (3-fold serial dilution). Due to the bivalent structure of the TGN1412 and its avidity-driven binding, the concentration range of unlabeled TGN1412 was 10-fold reduced compared to the monovalent aVH-Fc constructs.

After an incubation time of 4 h at RT, the emission of the acceptor dye (665 nm) as well as of the donor dye (620 nm) was determined using a fluorescence Reader (Victor 3, Perkin Elmer). The ratio of acceptor to donor emission was calculated and the ratio of the background control (cells only incubated with d2-labeled anti-his tag antibody) subtracted. Curves were analysed in GraphPad Prism5 (FIG. 6) and Ki's calculated (Table 28).

TABLE 28

Ki values of TGN1412 epitope-competing aVHs.

| Clone ID | Ki (nM) (95% CI) |
| --- | --- |
| P023.001 | 3.3 (2.2-5.0) |
| P019.020 | 10.6 (6.9-16.0) |
| P023.017 | 10.7 (7.7-14.7) |
| P023.057 | 22.2 (14.4-34.3) |
| TGN 1412 | 0.28 (0.23-0.32) |

As previously identified by SPR, clones P023.001, P019.020, P023.017, and P023.057 are able to compete with labeled TGN1412 for binding to CD28 which leads to a clear reduction of the FRET signal. On the other hand, clone P020.027, a CD28-binding aVH-Fc construct with an alternative epitope, does not compete with TGN1412 and therefore reduces the FRET signal not or only marginally. Unlabeled TGN1412, on the other hand, is significantly more efficient in competing with its labeled counterpart due to its bivalent nature.

| SEQ ID NOs 248 to 405 | | |
|---|---|---|
| Chain/clone | Sequence/Info | SEQ ID NO |
| Leader peptide 1 | MDWTWRILFLVAAATGAHS | 248 |
| Leader peptide 2 | MGWSCIILFLVATATGVHS | 249 |
| hu(NA1)BA-avi-His | KLTIESTPFNVAEGKEVLLLVHNLPQHLFGYSWYKGERVDGNRQII GYVIGTQQATPGPAYSGREIIYPNASLLIQNIIQNDTGFYTLHVIKSD LVNEEATGQFRVYPELPKPSISSNNSKPVEDKDAVAFTCEPETQDA TYLWWVNNQSLPVSPRLQLSNGNRTLTLFNVTRNDSASYKCETQ NPVSARRSDSVILNVLYGPDTPTISPSDTYYRPGANLSLSCYAASNP PAQYSWLINGTFQQSTQELFIPNITVNNSGSYTCHANNSVTGCNRT TVKTIIVTELSPVVAKPQIKASKTTVTGDKDSVNLTCSTNDTGISIR WFFKNQSLPSSERMKLSQGNITLSINPVKREDAGTYWCEVFNPISK NQSDPIMLNVYNYNALPQENLINVDEQLYFQGGSGLNDIFEAQKIE WHEARAHHHHHH | 250 |
| Hu CD28 Fc-knob-avi | NKILVKQSPMLVAYDNAVNLSCKYSYNLFSREFRASLHKGLDSAV EVCVVYGNYSQQLQVYSKTGFNCDGKLGNESVTFYLQNLYVNQT DIYFCKIEVMYPPPYLDNEKSNGTIIHVKGKHLCPSPLFPGPSKPGS DKTHTCPPCPAPEAAGGPSVFLFPPKPKDTLMISRTPEVTCVVVDV SHEDPEVKFNWYVDGVEVHNAKTKPREEQYNSTYRVVSVLTVLH QDWLNGKEYKCKVSNKALGAPIEKTISKAKGQPREPQVYTLPPCR DELTKNQVSLWCLVKGFYPSDIAVEWESNGQPENNYKTTPPVLDS DGSFFLYSKLTVDKSRWQQGNVFSCSVMHEALHNHYTQKSLSLSP GKSGGLNDIFEAQKIEWHE | 251 |
| Hu CD28 Fc-hole | NKILVKQSPMLVAYDNAVNLSCKYSYNLFSREFRASLHKGLDSAV EVCVVYGNYSQQLQVYSKTGFNCDGKLGNESVTFYLQNLYVNQT DIYFCKIEVMYPPPYLDNEKSNGTIIHVKGKHLCPSPLFPGPSKPGS DKTHTCPPCPAPEAAGGPSVFLFPPKPKDTLMISRTPEVTCVVVDV SHEDPEVKFNWYVDGVEVHNAKTKPREEQYNSTYRVVSVLTVLH QDWLNGKEYKCKVSNKALGAPIEKTISKAKGQPREPQVCTLPPSR DELTKNQVSLSCAVKGFYPSDIAVEWESNGQPENNYKTTPPVLDS DGSFFLVSKLTVDKSRWQQGNVFSCSVMHEALHNHYTQKSLSLSP GK | 252 |
| human FAP avi his | RPSRVHNSEENTMRALTLKDILNGTFSYKTFFPNWISGQEYLHQSA DNNIVLYNIETGQSYTILSNRTMKSVNASNYGLSPDRQFVYLESDY SKLWRYSYTATYYIYDLSNGEFVRGNELPRPIQYLCWSPVGSKLA YVYQNNIYLKQRPGDPPFQITFNGRENKIFNGIPDWVYEEEMLATK YALWWSPNGKFLAYAEFNDTDIPVIAYSYYGDEQYPRTINIPYPKA GAKNPVVRIFIIDTTYPAYVGPQEVPVPAMIASSDYYFSWLTWVTD ERVCLQWLKRVQNVSVLSICDFREDWQTWDCPKTQEHIEESRTG WAGGFFVSTPVFSYDAISYYKIFSDKDGYKHIHYIKDTVENAIQITS GKWEAINIFRVTQDSLFYSSNEFEEYPGRRNIYRISIGSYPPSKKCVT CHLRKERCQYYTASFSDYAKYYALVCYGPGIPISTLHDGRTDQEIK ILEENKELENALKNIQLPKEEIKKLEVDEITLWYKMILPPQFDRSKK YPLLIQVYGGPCSQSVRSVFAVNWISYLASKEGMVIALVDGRGTA FQGDKLLYAVYRKLGVYEVEDQITAVRKFIEMGFIDEKRIAIWGW SYGGYVSSLALASGTGLFKCGIAVAPVSSWEYYASVYTERFMGLP TKDDNLEHYKNSTVMARAEYFRNVDYLLIHGTADDNVHFQNSAQ IAKALVNAQVDFQAMWYSDQNHGLSGLSTNHLYTHMTHFLKQCF SLSVDEQLYFQGGSGLNDIFEAQKIEWHEARAHHHHHH | 253 |
| murine FAP avi his | RPSRVYKPEGNTKRALTLKDILNGTFSYKTYFPNWISEQEYLHQSE DDNIVFYNIETRESYIILSNSTMKSVNATDYGLSPDRQFVYLESDYS KLWRYSYTATYYIYDLQNGEFVRGYELPRPIQYLCWSPVGSKLAY VYQNNIYLKQRPGDPPFQITYTGRENRIFNGIPDWVYEEEMLATKY ALWWSPDGKFLAYVEFNDSDIPIIAYSYYGDGQYPRTINIPYPKAG AKNPVVRVFIVDTTYPHHVGPMEVPVPEMIASSDYYFSWLTWVSS ERVCLQWLKRVQNVSVLSICDFREDWHAWECPKNQEHVEESRTG WAGGFFVSTPAFSQDATSYYKIFSDKDGYKHIHYIKDTVENAIQITS GKWEAIYIFKVTQDSLFYSSNEFEGYPGRRNIYRISIGNSPPSKKCVT CHLRKERCQYYTASFSYKAKYYALVCYGPGLPISTLHDGRTDQEI QVLEENKELENSLRNIQLPKVEIKKLKDGGLTFWYKMILPPQFDRS KKYPLLIQVYGGPCSQSVKSVFAVNWITYLASKEGIVIALVDGRGT APQGDKFLHAVYRKLGVYEVEDQLTAVRKFIEMGFIDEERIAIWG WSYGGYVSSLALASGTGLFKCGIAVAPVSSWEYYASIYSERFMGL PTKDDNLEHYKNSTVMARAEYFRNVDYLLIHGTADDNVHFQNSA QIAKALVNAQVDFQAMWYSDQNHGILSGRSQNHLYTHMTHFLKQ CFSLSDVDEQLYFQGGSGLNDIFEAQKIEWHEARAHHHHHH | 254 |
| CEACAM1-avi-his | QLTTESMPFNVAEGKEVLLLVHNLPQQLFGYSWYKGERVDGNRQ IVGYAIGTQQATPGPANSGRETIYPNASLLIQNVTQNDTGFYTLQVI KSDLVNEEATGQFHVYPELPKPSISSNNSNPVEDKDAMAFTCEPET QDTTYLWWINNQSLPVSPRLQLSNGNRTLTLLSVTRNDTGPYECEI | 255 |

SEQ ID NOs 248 to 405

| Chain/clone | Sequence/Info | SEQ ID NO |
|---|---|---|
| | QNPVSANRSDPVTLNVTYGPDTPTISPSDTYYRPGANLSLSCYAAS NPPAQYSWLINGTFQQSTQELFIPNITVNNSGSYTCHANNSVTGCN RTTVKTIIVTELSPVVAKPQIKASKTTVTGDKDSVNLTCSTNDTGISI RWFFKNQSLPSSERMKLSQGNITLSINPVKREDAGTYWCEVFNPIS KNQSDPIMLNVNYNALPQENLINVDLEVLFQGPGSGLNDIFEAQKI EWHEARAHHHHHH | |
| Phagemid template_G44E_T45E_F(100-1)Y_P52aC_A71C_G26S | EVQLVESGGGLVQPGGSLRLSCAASSFNIKDTYIGWVRRAPGKEEE LVAEIYCDIGYTRYADSVKGRFTISCDTSKNTAYLQMNSLRAEDTA VYYCAAVEVAEYYEYWGQGTTVTVSS | 256 |
| Phagemid template_G44E_T45E_F(100-1)Y_P52aC_A71C_S31ab | EVQLVESGGGLVQPGGSLRLSCAASGFNIKDSSTYIGWVRRAPGK EEELVAEIYCDIGYTRYADSVKGRFTISCDTSKNTAYLQMNSLRAE DTAVYYCAAVEVAEYYEYWGQGTTVTVSS | 257 |
| Phagemid template_G44E_T45E_F(100-1)Y_Y33C_Y52C | EVQLVESGGGLVQPGGSLRLSCAASGFNIKDTCIGWVRRAPGKEE ELVAEICQDIGYTRYADSVKGRFTISADTSKNTAYLQMNSLRAEDT AVYYCAAVEVAEYYEYWGQGTTVTVSS | 258 |
| Fc (hole) | DKTHTCPPCPAPELLGGPSVFLFPPKPKDTLMISRTPEVTCVVV DVSHEDPEVKFNWYVDGVEVHNAKTKPREEQYNSTYRVVSVL TVLHQDWLNGKEYKCKVSNKALPAPIEKTISKAKGQPREPQVC TLPPSRDELTKNQVSLSCAVKGFYPSDIAVEWESNGQPENNYK TTPPVLDSDGSFFLVSKLTVDKSRWQQGNVFSCSVMHEALHNR FTQKSLSLSPGK | 259 |
| FAP aVH binders (only aVH) | | |
| P011.064 | EVQLVESGGGLVQPGGSLRLSCAASGFNIKDTCIGWVRRAPGKEEELV ANICITDGKTRYADSVKGRFTISADTSKNTAYLQMNSLRAEDTAVYY CAYYSKYIGYRYWGQGTTVTVSS | 260 |
| P011.080 | EVQLVESGGGLVQPGGSLRLSCAASGFNIKDTCIGWVRRAPGKEEELV ANICQSGGYTRYADSVKGRFTISADTSKNTAYLQMNSLRAEDTAVYY CARYHKGVGYQYWGQGTTVTVSS | 261 |
| P012.090 | EVQLVESGGGLVQPGGSLRLSCAASSFNIKDTYIGWVRRAPGKEEELV AKIFRCSDGRTRYADSVKGRFTISCDTSKNTAYLQMNSLRAEDTAVY YCANIYKTHYTYWGQGTTVTVSS | 262 |
| P014.087 | EVQLVESGGGLVQPGGSLRLSCAASGFNIKDTCIGWVRRAPGKEEELV ANICGHIGSTRYADSVKGRFTISADTSKNTAYLQMNSLRAEDTAVYYC ANSYTYSYKYWGQGTTVTVSS | 263 |
| P031.033 | EVQLVESGGGLVQPGGSLRLSCAASGFNIKDTCIGWVRRAPGKEEELV ANICGQYGQTRYADSVKGRFTISADTSKNTAYLQMNSLRAEDTAVYY CAKSGGRHGYEYWGQGTTVTVSS | 264 |
| P031.078 | EVQLVESGGGLVQPGGSLRLSCAASGFNIKDTCIGWVRRAPGKEEELV ANICGTTGSTRYADSVKGRFTISADTSKNTAYLQMNSLRAEDTAVYY CANSWTIYRYKYWGQGTTVTVSS | 265 |
| P032.056 | EVQLVESGGGLVQPGGSLRLSCAASSFNIKDTYIGWVRRAPGKEEELV ANIHCRSGYTRYADSVKGRFTISCDTSKNTAYLQMNSLRAEDTAVYY CAHSGSRYIYKYWGQGTTVTVSS | 266 |
| P034.001 | EVQLVESGGGLVQPGGSLRLSCAASGFNIKDTCIGWVRRAPGKEEELV ANICGSIGATRYADSVKGRFTISADTSKNTAYLQMNSLRAEDTAVYYC AKSGGHKGYRYWGQGTTVTVSS | 267 |
| P034.007 | EVQLVESGGGLVQPGGSLRLSCAASGFNIKDTCIGWVRRAPGKEEELV ANICGGDGHTRYADSVKGRFTISADTSKNTAYLQMNSLRAEDTAVYY CATSYTVYRYYYWGQGTTVTVSS | 268 |
| P034.066 | EVQLVESGGGLVQPGGSLRLSCAASGFNIKDTCIGWVRRAPGKEEELV ANICGITGYTRYADSVKGRFTISADTSKNTAYLQMNSLRAEDTAVYY CAKSGGPKGYTYWGQGTTVTVSS | 269 |
| P034.090 | EVQLVESGGGLVQPGGSLRLSCAASGFNIKDTCIGWVRRAPGKEEELV ANICSSYGHTRYADSVKGRFTISADTSKNTAYLQMNSLRAEDTAVYY CASSYTIYRYSYWGQGTTVTVSS | 270 |

-continued

SEQ ID NOs 248 to 405

| Chain/clone | Sequence/Info | SEQ ID NO |
|---|---|---|
| P046.052 | EVQLVESGGGLVQPGGSLRLSCAASGFNIKDSSTYIGWVRRAPGKEEE<br>LVARIQCSSGSTRYADSVKGRFTISCDTSKNTAYLQMNSLRAEDTAVY<br>YCAGRQSYNYGYIYWGQGTTVTVSS | 271 |
| P047.001 | EVQLVESGGGLVQPGGSLRLSCAASGFNIKDTCIGWVRRAPGKEEELV<br>ANICGKIGITRYADSVKGRFTISADTSKNTAYLQMNSLRAEDTAVYYC<br>ANSYTIVRYDYWGQGTTVTVSS | 272 |
| P048.019 | EVQLVESGGGLVQPGGSLRLSCAASGFNIKDTCIGWVRRAPGKEEELV<br>ANICPKHGATRYADSVKGRFTISADTSKNTAYLQMNSLRAEDTAVYY<br>CAYSGNVYNRYKYWGQGTTVTVSS | 273 |
| P049.004 | EVQLVESGGGLVQPGGSLRLSCAASSFNIKDTYIGWVRRAPGKEEELV<br>ANIYCNYGYTRYADSVKGRFTISCDTSKNTAYLQMNSLRAEDTAVYY<br>CATSHTRYHYKYWGQGTTVTVSS | 274 |
| P053.020 | EVQLVESGGGLVQPGGSLRLSCAASGFNIKDTCIGWVRRAPGKEEELV<br>ARICGQIGSTRYADSVKGRFTISADTSKNTAYLQMNSLRAEDTAVYYC<br>ATSYTVYRSYDYWGQGTTVTVSS | 275 |
| P054.035 | EVQLVESGGGLVQPGGSLRLSCAASGFNIKDTCIGWVRRAPGKEEELV<br>ANICGSYGHTRYADSVKGRFTISADTSKNTAYLQMNSLRAEDTAVYY<br>CASSYTVYRSYAYWGQGTTVTVSS | 276 |
| P054.064 | EVQLVESGGGLVQPGGSLRLSCAASGFNIKDTCIGWVRRAPGKEEELV<br>ANICGSNGYTRYADSVKGRFTISADTSKNTAYLQMNSLRAEDTAVYY<br>CASSYTVYRGYDYWGQGTTVTVSS | 277 |
| P058.068 | EVQLVESGGGLVQPGGSLRLSCAASGFNIKDTCIGWVRRAPGKEEELV<br>ANICQTHGYTRYADSVKGRFTISADTSKNTAYLQMNSLRAEDTAVYY<br>CAYKGGGRYYDYWGQGTTVTVSS | 278 |
| P060.092 | EVQLVESGGGLVQPGGSLRLSCAASGFNIKDSSTYIGWVRRAPGKEEE<br>LVARIQCSAGSTRYADSVKGRFTISCDTSKNTAYLQMNSLRAEDTAV<br>YYCAGRSARSYSYIYWGQGTTVTVSS | 279 |
| Anti-FAP<br>aVH-Fc<br>fusions | | |
| monovalent<br>anti-FAP<br>aVH-Fc<br>(knob)<br>P011.064 | EVQLVESGGGLVQPGGSLRLSCAASGFNIKDTCIGWVRRAPGKEE<br>ELVANICITDGKTRYADSVKGRFTISADTSKNTAYLQMNSLRAEDT<br>AVYYCAYYSKYIGYRYWGQGTTVTVSSGGGGSGGGGSDKTHTCP<br>PCPAPEAAGGPSVFLFPPKPKDTLMISRTPEVTCVVVDVSHEDPEV<br>KFNWYVDGVEVHNAKTKPREEQYNSTYRVVSVLTVLHQDWLNG<br>KEYKCKVSNKALGAPIEKTISKAKGQPREPQVYTLPPCRDELTKNQ<br>VSLWCLVKGFYPSDIAVEWESNGQPENNYKTTPPVLDSDGSFFLY<br>SKLTVDKSRWQQGNVFSCSVMHEALHNHYTQKSLSLSPGK | 280 |
| monovalent<br>anti-FAP<br>aVH-Fc<br>(knob)<br>P011.080 | EVQLVESGGGLVQPGGSLRLSCAASGFNIKDTCIGWVRRAPGKEE<br>ELVANICQSGGYTRYADSVKGRFTISADTSKNTAYLQMNSLRAED<br>TAVYYCARYHKGVGYQYWGQGTTVTVSSGGGGSGGGGSDKTHT<br>CPPCPAPEAAGGPSVFLFPPKPKDTLMISRTPEVTCVVVDVSHEDPE<br>VKFNWYVDGVEVHNAKTKPREEQYNSTYRVVSVLTVLHQDWLN<br>GKEYKCKVSNKALGAPIEKTISKAKGQPREPQVYTLPPCRDELTKN<br>QVSLWCLVKGFYPSDIAVEWESNGQPENNYKTTPPVLDSDGSFFL<br>YSKLTVDKSRWQQGNVFSCSVMHEALHNHYTQKSLSLSPGK | 281 |
| monovalent<br>anti-FAP<br>aVH-Fc<br>(knob)<br>P012.090 | EVQLVESGGGLVQPGGSLRLSCAASSFNIKDTYIGWVRRAPGKEEE<br>LVAKIFRCSDGRTRYADSVKGRFTISCDTSKNTAYLQMNSLRAED<br>TAVYYCANIYKTHYTYWGQGTTVTVSSGGGGSGGGGSDKTHTCP<br>PCPAPEAAGGPSVFLFPPKPKDTLMISRTPEVTCVVVDVSHEDPEV<br>KFNWYVDGVEVHNAKTKPREEQYNSTYRVVSVLTVLHQDWLNG<br>KEYKCKVSNKALGAPIEKTISKAKGQPREPQVYTLPPCRDELTKNQ<br>VSLWCLVKGFYPSDIAVEWESNGQPENNYKTTPPVLDSDGSFFLY<br>SKLTVDKSRWQQGNVFSCSVMHEALHNHYTQKSLSLSPGK | 282 |
| monovalent<br>anti-FAP<br>aVH-Fc<br>(knob)<br>P014.087 | EVQLVESGGGLVQPGGSLRLSCAASGFNIKDTCIGWVRRAPGKEE<br>ELVANICGHIGSTRYADSVKGRFTISADTSKNTAYLQMNSLRAEDT<br>AVYYCANSYTYSYKYWGQGTTVTVSSGGGGSGGGGSDKTHTCPP<br>CPAPEAAGGPSVFLFPPKPKDTLMISRTPEVTCVVVDVSHEDPEVK<br>FNWYVDGVEVHNAKTKPREEQYNSTYRVVSVLTVLHQDWLNGK<br>EYKCKVSNKALGAPIEKTISKAKGQPREPQVYTLPPCRDELTKNQV | 283 |

-continued

| Chain/clone | Sequence/Info | SEQ ID NO |
|---|---|---|
| | SLWCLVKGFYPSDIAVEWESNGQPENNYKTTPPVLDSDGSFFLYS<br>KLTVDKSRWQQGNVFSCSVMHEALHNHYTQKSLSLSPGK | |
| monovalent<br>anti-FAP<br>aVH-Fc<br>(knob)<br>P031.033 | EVQLVESGGGLVQPGGSLRLSCAASGFNIKDTCIGWVRRAPGKEE<br>ELVANICGQYGQTRYADSVKGRFTISADTSKNTAYLQMNSLRAED<br>TAVYYCAKSGGRHGYEYWGQGTTVTVSSGGGGSGGGGSDKTHT<br>CPPCPAPEAAGGPSVFLFPPKPKDTLMISRTPEVTCVVVDVSHEDPE<br>VKFNWYVDGVEVHNAKTKPREEQYNSTYRVVSVLTVLHQDWLN<br>GKEYKCKVSNKALGAPIEKTISKAKGQPREPQVYTLPPCRDELTKN<br>QVSLWCLVKGFYPSDIAVEWESNGQPENNYKTTPPVLDSDGSFFL<br>YSKLTVDKSRWQQGNVFSCSVMHEALHNHYTQKSLSLSPGK | 284 |
| monovalent<br>anti-FAP<br>aVH-Fc<br>(knob)<br>P031.078 | EVQLVESGGGLVQPGGSLRLSCAASGFNIKDTCIGWVRRAPGKEE<br>ELVANICGTTGSTRYADSVKGRFTISADTSKNTAYLQMNSLRAED<br>TAVYYCANSWTIYRYKYWGQGTTVTVSSGGGGSGGGGSDKTHT<br>CPPCPAPEAAGGPSVFLFPPKPKDTLMISRTPEVTCVVVDVSHEDPE<br>VKFNWYVDGVEVHNAKTKPREEQYNSTYRVVSVLTVLHQDWLN<br>GKEYKCKVSNKALGAPIEKTISKAKGQPREPQVYTLPPCRDELTKN<br>QVSLWCLVKGFYPSDIAVEWESNGQPENNYKTTPPVLDSDGSFFL<br>YSKLTVDKSRWQQGNVFSCSVMHEALHNHYTQKSLSLSPGK | 285 |
| monovalent<br>anti-FAP<br>aVH-Fc<br>(knob)<br>P032.056 | EVQLVESGGGLVQPGGSLRLSCAASSFNIKDTYIGWVRRAPGKEEE<br>LVANIHCRSGYTRYADSVKGRFTISCDTSKNTAYLQMNSLRAEDT<br>AVYYCAHSGSRYIYKYWGQGTTVTVSSGGGGSGGGGSDKTHTCP<br>PCPAPEAAGGPSVFLFPPKPKDTLMISRTPEVTCVVVDVSHEDPEV<br>KFNWYVDGVEVHNAKTKPREEQYNSTYRVVSVLTVLHQDWLNG<br>KEYKCKVSNKALGAPIEKTISKAKGQPREPQVYTLPPCRDELTKNQ<br>VSLWCLVKGFYPSDIAVEWESNGQPENNYKTTPPVLDSDGSFFLY<br>SKLTVDKSRWQQGNVFSCSVMHEALHNHYTQKSLSLSPGK | 286 |
| monovalent<br>anti-FAP<br>aVH-Fc<br>(knob)<br>P034.001 | EVQLVESGGGLVQPGGSLRLSCAASGFNIKDTCIGWVRRAPGKEE<br>ELVANICGSIGATRYADSVKGRFTISADTSKNTAYLQMNSLRAEDT<br>AVYYCAKSGGHKGYRYWGQGTTVTVSSGGGGSGGGGSDKTHTC<br>PPCPAPEAAGGPSVFLFPPKPKDTLMISRTPEVTCVVVDVSHEDPE<br>VKFNWYVDGVEVHNAKTKPREEQYNSTYRVVSVLTVLHQDWLN<br>GKEYKCKVSNKALGAPIEKTISKAKGQPREPQVYTLPPCRDELTKN<br>QVSLWCLVKGFYPSDIAVEWESNGQPENNYKTTPPVLDSDGSFFL<br>YSKLTVDKSRWQQGNVFSCSVMHEALHNHYTQKSLSLSPGK | 287 |
| monovalent<br>anti-FAP<br>aVH-Fc<br>(knob)<br>P034.007 | EVQLVESGGGLVQPGGSLRLSCAASGFNIKDTCIGWVRRAPGKEE<br>ELVANICGGDGHTRYADSVKGRFTISADTSKNTAYLQMNSLRAED<br>TAVYYCATSYTVYRYYYWGQGTTVTVSSGGGGSGGGGSDKTHT<br>CPPCPAPEAAGGPSVFLFPPKPKDTLMISRTPEVTCVVVDVSHEDPE<br>VKFNWYVDGVEVHNAKTKPREEQYNSTYRVVSVLTVLHQDWLN<br>GKEYKCKVSNKALGAPIEKTISKAKGQPREPQVYTLPPCRDELTKN<br>QVSLWCLVKGFYPSDIAVEWESNGQPENNYKTTPPVLDSDGSFFL<br>YSKLTVDKSRWQQGNVFSCSVMHEALHNHYTQKSLSLSPGK | 288 |
| monovalent<br>anti-FAP<br>aVH-Fc<br>(knob)<br>P034.066 | EVQLVESGGGLVQPGGSLRLSCAASGFNIKDTCIGWVRRAPGKEE<br>ELVANICGITGYTRYADSVKGRFTISADTSKNTAYLQMNSLRAEDT<br>AVYYCAKSGGPKGYTYWGQGTTVTVSSGGGGSGGGGSDKTHTC<br>PPCPAPEAAGGPSVFLFPPKPKDTLMISRTPEVTCVVVDVSHEDPE<br>VKFNWYVDGVEVHNAKTKPREEQYNSTYRVVSVLTVLHQDWLN<br>GKEYKCKVSNKALGAPIEKTISKAKGQPREPQVYTLPPCRDELTKN<br>QVSLWCLVKGFYPSDIAVEWESNGQPENNYKTTPPVLDSDGSFFL<br>YSKLTVDKSRWQQGNVFSCSVMHEALHNHYTQKSLSLSPGK | 289 |
| monovalent<br>anti-FAP<br>aVH-Fc<br>(knob)<br>P034.090 | EVQLVESGGGLVQPGGSLRLSCAASGFNIKDTCIGWVRRAPGKEE<br>ELVANICSSYGHTRYADSVKGRFTISADTSKNTAYLQMNSLRAED<br>TAVYYCASSYTIYRYSYWGQGTTVTVSSGGGGSGGGGSDKTHTC<br>PPCPAPEAAGGPSVFLFPPKPKDTLMISRTPEVTCVVVDVSHEDPE<br>VKFNWYVDGVEVHNAKTKPREEQYNSTYRVVSVLTVLHQDWLN<br>GKEYKCKVSNKALGAPIEKTISKAKGQPREPQVYTLPPCRDELTKN<br>QVSLWCLVKGFYPSDIAVEWESNGQPENNYKTTPPVLDSDGSFFL<br>YSKLTVDKSRWQQGNVFSCSVMHEALHNHYTQKSLSLSPGK | 290 |
| monovalent<br>anti-FAP<br>aVH-Fc<br>(knob)<br>P046.052 | EVQLVESGGGLVQPGGSLRLSCAASGFNIKDSSTYIGWVRRAPGK<br>EEELVARIQCSSGSTRYADSVKGRFTISCDTSKNTAYLQMNSLRAE<br>DTAVYYCAGRQSYNYGYIYWGQGTTVTVSSGGGGSGGGGSDKT<br>HTCPPCPAPEAAGGPSVFLFPPKPKDTLMISRTPEVTCVVVDVSHE<br>DPEVKFNWYVDGVEVHNAKTKPREEQYNSTYRVVSVLTVLHQD<br>WLNGKEYKCKVSNKALGAPIEKTISKAKGQPREPQVYTLPPCRDE<br>LTKNQVSLWCLVKGFYPSDIAVEWESNGQPENNYKTTPPVLDSDG<br>SFFLYSKLTVDKSRWQQGNVFSCSVMHEALHNHYTQKSLSLSPGK | 291 |

| Chain/clone | Sequence/Info | SEQ ID NO |
|---|---|---|
| monovalent anti-FAP aVH-Fc (knob) P047.001 | EVQLVESGGGLVQPGGSLRLSCAASGFNIKDTCIGWVRRAPGKEE ELVANICGKIGITRYADSVKGRFTISADTSKNTAYLQMNSLRAEDT AVYYCANSYTIVRYDYWGQGTTVTVSSGGGGSGGGGSDKTHTCP PCPAPEAAGGPSVFLFPPKPKDTLMISRTPEVTCVVVDVSHEDPEV KFNWYVDGVEVHNAKTKPREEQYNSTYRVVSVLTVLHQDWLNG KEYKCKVSNKALGAPIEKTISKAKGQPREPQVYTLPPCRDELTKNQ VSLWCLVKGFYPSDIAVEWESNGQPENNYKTTPPVLDSDGSFFLY SKLTVDKSRWQQGNVFSCSVMHEALHNHYTQKSLSLSPGK | 292 |
| monovalent anti-FAP aVH-Fc (knob) P048.019 | EVQLVESGGGLVQPGGSLRLSCAASGFNIKDTCIGWVRRAPGKEE ELVANICPKHGATRYADSVKGRFTISADTSKNTAYLQMNSLRAED TAVYYCAYSGNVYNRYKYWGQGTTVTVSSGGGGSGGGGSDKTH TCPPCPAPEAAGGPSVFLFPPKPKDTLMISRTPEVTCVVVDVSHEDP EVKFNWYVDGVEVHNAKTKPREEQYNSTYRVVSVLTVLHQDWL NGKEYKCKVSNKALGAPIEKTISKAKGQPREPQVYTLPPCRDELTK NQVSLWCLVKGFYPSDIAVEWESNGQPENNYKTTPPVLDSDGSFF LYSKLTVDKSRWQQGNVFSCSVMHEALHNHYTQKSLSLSPGK | 293 |
| monovalent anti-FAP aVH-Fc (knob) P049.004 | EVQLVESGGGLVQPGGSLRLSCAASSFNIKDTYIGWVRRAPGKEEE LVANIYCNYGYTRYADSVKGRFTISCDTSKNTAYLQMNSLRAEDT AVYYCATSHTRYHYKYWGQGTTVTVSSGGGGSGGGGSDKTHTC PPCPAPEAAGGPSVFLFPPKPKDTLMISRTPEVTCVVVDVSHEDPE VKFNWYVDGVEVHNAKTKPREEQYNSTYRVVSVLTVLHQDWLN GKEYKCKVSNKALGAPIEKTISKAKGQPREPQVYTLPPCRDELTKN QVSLWCLVKGFYPSDIAVEWESNGQPENNYKTTPPVLDSDGSFFL YSKLTVDKSRWQQGNVFSCSVMHEALHNHYTQKSLSLSPGK | 294 |
| monovalent anti-FAP aVH-Fc (knob) P053.020 | EVQLVESGGGLVQPGGSLRLSCAASGFNIKDTCIGWVRRAPGKEE ELVARICGQIGSTRYADSVKGRFTISADTSKNTAYLQMNSLRAEDT AVYYCATSYTVYRSYDYWGQGTTVTVSSGGGGSGGGGSDKTHT CPPCPAPEAAGGPSVFLFPPKPKDTLMISRTPEVTCVVVDVSHEDPE VKFNWYVDGVEVHNAKTKPREEQYNSTYRVVSVLTVLHQDWLN GKEYKCKVSNKALGAPIEKTISKAKGQPREPQVYTLPPCRDELTKN QVSLWCLVKGFYPSDIAVEWESNGQPENNYKTTPPVLDSDGSFFL YSKLTVDKSRWQQGNVFSCSVMHEALHNHYTQKSLSLSPGK | 295 |
| monovalent anti-FAP aVH-Fc (knob) P054.035 | EVQLVESGGGLVQPGGSLRLSCAASGFNIKDTCIGWVRRAPGKEE ELVANICGSYGHTRYADSVKGRFTISADTSKNTAYLQMNSLRAED TAVYYCASSYTVYRSYAYWGQGTTVTVSSGGGGSGGGGSDKTH CPPCPAPEAAGGPSVFLFPPKPKDTLMISRTPEVTCVVVDVSHEDPE VKFNWYVDGVEVHNAKTKPREEQYNSTYRVVSVLTVLHQDWLN GKEYKCKVSNKALGAPIEKTISKAKGQPREPQVYTLPPCRDELTKN QVSLWCLVKGFYPSDIAVEWESNGQPENNYKTTPPVLDSDGSFFL YSKLTVDKSRWQQGNVFSCSVMHEALHNHYTQKSLSLSPGK | 296 |
| monovalent anti-FAP aVH-Fc (knob) P054.064 | EVQLVESGGGLVQPGGSLRLSCAASGFNIKDTCIGWVRRAPGKEE ELVANICGSNGYTRYADSVKGRFTISADTSKNTAYLQMNSLRAED TAVYYCASSYTVYRGYDYWGQGTTVTVSSGGGGSGGGGSDKTH TCPPCPAPEAAGGPSVFLFPPKPKDTLMISRTPEVTCVVVDVSHEDP EVKFNWYVDGVEVHNAKTKPREEQYNSTYRVVSVLTVLHQDWL NGKEYKCKVSNKALGAPIEKTISKAKGQPREPQVYTLPPCRDELTK NQVSLWCLVKGFYPSDIAVEWESNGQPENNYKTTPPVLDSDGSFF LYSKLTVDKSRWQQGNVFSCSVMHEALHNHYTQKSLSLSPGK | 297 |
| monovalent anti-FAP aVH-Fc (knob) P058.068 | EVQLVESGGGLVQPGGSLRLSCAASGFNIKDTCIGWVRRAPGKEE ELVANICQTHGYTRYADSVKGRFTISADTSKNTAYLQMNSLRAED TAVYYCAYKGGGRYYDYWGQGTTVTVSSGGGGSGGGGSDKTHT CPPCPAPEAAGGPSVFLFPPKPKDTLMISRTPEVTCVVVDVSHEDPE VKFNWYVDGVEVHNAKTKPREEQYNSTYRVVSVLTVLHQDWLN GKEYKCKVSNKALGAPIEKTISKAKGQPREPQVYTLPPCRDELTKN QVSLWCLVKGFYPSDIAVEWESNGQPENNYKTTPPVLDSDGSFFL YSKLTVDKSRWQQGNVFSCSVMHEALHNHYTQKSLSLSPGK | 298 |
| monovalent anti-FAP aVH-Fc (knob) P060.092 | EVQLVESGGGLVQPGGSLRLSCAASGFNIKDSSTYIGWVRRAPGK EEELVARIQCSAGSTRYADSVKGRFTISCDTSKNTAYLQMNSLRAE DTAVYYCAGRSARSYSYIYWGQGTTVTVSSGGGGSGGGGSDKTH TCPPCPAPEAAGGPSVFLFPPKPKDTLMISRTPEVTCVVVDVSHEDP EVKFNWYVDGVEVHNAKTKPREEQYNSTYRVVSVLTVLHQDWL NGKEYKCKVSNKALGAPIEKTISKAKGQPREPQVYTLPPCRDELTK NQVSLWCLVKGFYPSDIAVEWESNGQPENNYKTTPPVLDSDGSFF LYSKLTVDKSRWQQGNVFSCSVMHEALHNHYTQKSLSLSPGK | 299 |

| SEQ ID NOs 248 to 405 | | |
|---|---|---|
| Chain/clone | Sequence/Info | SEQ ID NO |
| CEA aVH binders (only aVH) | | |
| P112.068 | EVQLVESGGGLVQPGGSLRLSCAASGFNIKDTCIGWVRRAPGKEE ELVAKICKYSGHTRYADSVKGRFTISADTSKNTAYLQMNSLRAED TAVYYCAAVSVRDGHYNYWGQGTTVTVSS | 300 |
| P112.083 | EVQLVESGGGLVQPGGSLRLSCAASGFNIKDTCIGWVRRAPGKEE ELVADICPYKGSTRYADSVKGRFTISADTSKNTAYLQMNSLRAED TAVYYCAIVSARDGYYNYWGQGTTVTVSS | 301 |
| P118.008 | EVQLVESGGGLVQPGGSLRLSCAASGFNIKDTCIGWVRRAPGKEE ELVAYICNYTGYTRYADSVKGRFTISADTSKNTAYLQMNSLRAED TAVYYCAITSYHGQYNYWGQGTTVTVSS | 302 |
| P118.061 | EVQLVESGGGLVQPGGSLRLSCAASGFNIKDTCIGWVRRAPGKEE ELVANICPYHGYTRYADSVKGRFTISADTSKNTAYLQMNSLRAED TAVYYCAIVSYVDEYYNYWGQGTTVTVSS | 303 |
| P118.089 | EVQLVESGGGLVQPGGSLRLSCAASGFNIKDTCIGWVRRAPGKEE ELVASICQYSGYTRYADSVKGRFTISADTSKNTAYLQMNSLRAED TAVYYCAITSHHGDYNYWGQGTTVTVSS | 304 |
| P118.093 | EVQLVESGGGLVQPGGSLRLSCAASGFNIKDTCIGWVRRAPGKEE ELVADICPSYGGTRYADSVKGRFTISADTSKNTAYLQMNSLRAED TAVYYCAIVSKIDQYYNYWGQGTTVTVSS | 305 |
| P123.065 | EVQLVESGGGLVQPGGSLRLSCAASGFNIKDSSTYIGWVRRAPGK EEELVASISCSRGNTRYADSVKGRFTISCDTSKNTAYLQMNSLRAE DTAVYYCAHPRYTWYDYWGQGTTVTVSS | 306 |
| P124.021 | EVQLVESGGGLVQPGGSLRLSCAASGFNIKDTCIGWVRRAPGKEE ELVAAICPYKGYTRYADSVKGRFTISADTSKNTAYLQMNSLRAED TAVYYCANVAYSGGHYNYWGQGTTVTVSS | 307 |
| P124.034 | EVQLVESGGGLVQPGGSLRLSCAASGFNIKDTCIGWVRRAPGKEE ELVAAICPYIGETRYADSVKGRFTISADTSKNTAYLQMNSLRAEDT AVYYCATVARKYNQYNYWGQGTTVTVSS | 308 |
| P124.037 | EVQLVESGGGLVQPGGSLRLSCAASGFNIKDTCIGWVRRAPGKEE ELVAQICQYHGSTRYADSVKGRFTISADTSKNTAYLQMNSLRAED TAVYYCAIVGQNYPVYNYWGQGTTVTVSS | 309 |
| P124.067 | EVQLVESGGGLVQPGGSLRLSCAASGFNIKDTCIGWVRRAPGKEE ELVAAICEYKGYTRYADSVKGRFTISADTSKNTAYLQMNSLRAED TAVYYCAIASPVDQYYNYWGQGTTVTVSS | 310 |
| P127.002 | EVQLVESGGGLVQPGGSLRLSCAASGFNIKDTCIGWVRRAPGKEE ELVASICKYTGKTRYADSVKGRFTISADTSKNTAYLQMNSLRAED TAVYYCAIVASGDGWYNYWGQGTTVTVSS | 311 |
| P127.014 | EVQLVESGGGLVQPGGSLRLSCAASGFNIKDTCIGWVRRAPGKEE ELVAAICTYKGTTRYADSVKGRFTISADTSKNTAYLQMNSLRAED TAVYYCAIYSHYYDYYNYWGQGTTVTVSS | 312 |
| P127.141 | EVQLVESGGGLVQPGGSLRLSCAASGFNIKDTCIGWVRRAPGKEE ELVAGICEYTGSTRYADSVKGRFTISADTSKNTAYLQMNSLRAED TAVYYCAIVSQSRSVYNYWGQGTTVTVSS | 313 |
| Anti-CEA aVH-Fc fusions | | |
| monovalent anti-CEA aVH-Fc (knob) P112.068 | EVQLVESGGGLVQPGGSLRLSCAASGFNIKDTCIGWVRRAPGKEE ELVAKICKYSGHTRYADSVKGRFTISADTSKNTAYLQMNSLRAED TAVYYCAAVSVRDGHYNYWGQGTTVTVSSGGGGSGGGGSDKTH TCPPCPAPEAAGGPSVFLFPPKPKDTLMISRTPEVTCVVVDVSHEDP EVKFNWYVDGVEVHNAKTKPREEQYNSTYRVVSVLTVLHQDWL NGKEYKCKVSNKALGAPIEKTISKAKGQPREPQVYTLPPCRDELTK NQVSLWCLVKGFYPSDIAVEWESNGQPENNYKTTPPVLDSDGSFF LYSKLTVDKSRWQQGNVFSCSVMHEALHNHYTQKSLSLSPGK | 314 |

US 12,258,371 B2

-continued

SEQ ID NOs 248 to 405

| Chain/clone | Sequence/Info | SEQ ID NO |
| --- | --- | --- |
| monovalent anti-CEA aVH-Fc (knob) P112.083 | EVQLVESGGGLVQPGGSLRLSCAASGFNIKDTCIGWVRRAPGKEE ELVADICPYKGSTRYADSVKGRFTISADTSKNTAYLQMNSLRAED TAVYYCAIVSARDGYYNYWGQGTTVTVSSGGGGSGGGGSDKTHT CPPCPAPEAAGGPSVFLFPPKPKDTLMISRTPEVTCVVVDVSHEDPE VKFNWYVDGVEVHNAKTKPREEQYNSTYRVVSVLTVLHQDWLN GKEYKCKVSNKALGAPIEKTISKAKGQPREPQVYTLPPCRDELTKN QVSLWCLVKGFYPSDIAVEWESNGQPENNYKTTPPVLDSDGSFFL YSKLTVDKSRWQQGNVFSCSVMHEALHNHYTQKSLSLSPGK | 315 |
| monovalent anti-CEA aVH-Fc (knob) P118.008 | EVQLVESGGGLVQPGGSLRLSCAASGFNIKDTCIGWVRRAPGKEE ELVAYICNYTGYTRYADSVKGRFTISADTSKNTAYLQMNSLRAED TAVYYCAITSYHGQGYNYWGQGTTVTVSSGGGGSGGGGSDKTHT CPPCPAPEAAGGPSVFLFPPKPKDTLMISRTPEVTCVVVDVSHEDPE VKFNWYVDGVEVHNAKTKPREEQYNSTYRVVSVLTVLHQDWLN GKEYKCKVSNKALGAPIEKTISKAKGQPREPQVYTLPPCRDELTKN QVSLWCLVKGFYPSDIAVEWESNGQPENNYKTTPPVLDSDGSFFL YSKLTVDKSRWQQGNVFSCSVMHEALHNHYTQKSLSLSPGK | 316 |
| monovalent anti-CEA aVH-Fc (knob) P118.061 | EVQLVESGGGLVQPGGSLRLSCAASGFNIKDTCIGWVRRAPGKEE ELVANICPYHGYTRYADSVKGRFTISADTSKNTAYLQMNSLRAED TAVYYCAIVSYVDEYYNYWGQGTTVTVSSGGGGSGGGGSDKTHT CPPCPAPEAAGGPSVFLFPPKPKDTLMISRTPEVTCVVVDVSHEDPE VKFNWYVDGVEVHNAKTKPREEQYNSTYRVVSVLTVLHQDWLN GKEYKCKVSNKALGAPIEKTISKAKGQPREPQVYTLPPCRDELTKN QVSLWCLVKGFYPSDIAVEWESNGQPENNYKTTPPVLDSDGSFFL YSKLTVDKSRWQQGNVFSCSVMHEALHNHYTQKSLSLSPGK | 317 |
| monovalent anti-CEA aVH-Fc (knob) P118.089 | EVQLVESGGGLVQPGGSLRLSCAASGFNIKDTCIGWVRRAPGKEE ELVASICQYSGYTRYADSVKGRFTISADTSKNTAYLQMNSLRAED TAVYYCAITSHHGDYNYWGQGTTVTVSSGGGGSGGGGSDKTHTC PPCPAPEAAGGPSVFLFPPKPKDTLMISRTPEVTCVVVDVSHEDPE VKFNWYVDGVEVHNAKTKPREEQYNSTYRVVSVLTVLHQDWLN GKEYKCKVSNKALGAPIEKTISKAKGQPREPQVYTLPPCRDELTKN QVSLWCLVKGFYPSDIAVEWESNGQPENNYKTTPPVLDSDGSFFL YSKLTVDKSRWQQGNVFSCSVMHEALHNHYTQKSLSLSPGK | 318 |
| monovalent anti-CEA aVH-Fc (knob) P118.093 | EVQLVESGGGLVQPGGSLRLSCAASGFNIKDTCIGWVRRAPGKEE ELVADICPSYGGTRYADSVKGRFTISADTSKNTAYLQMNSLRAED TAVYYCAIVSKIDQYYNYWGQGTTVTVSSGGGGSGGGGSDKTHT CPPCPAPEAAGGPSVFLFPPKPKDTLMISRTPEVTCVVVDVSHEDPE VKFNWYVDGVEVHNAKTKPREEQYNSTYRVVSVLTVLHQDWLN GKEYKCKVSNKALGAPIEKTISKAKGQPREPQVYTLPPCRDELTKN QVSLWCLVKGFYPSDIAVEWESNGQPENNYKTTPPVLDSDGSFFL YSKLTVDKSRWQQGNVFSCSVMHEALHNHYTQKSLSLSPGK | 319 |
| monovalent anti-CEA aVH-Fc (knob) P123.065 | EVQLVESGGGLVQPGGSLRLSCAASGFNIKDSSTYIGWVRRAPGK EEELVASISCSRGNTRYADSVKGRFTISCDTSKNTAYLQMNSLRAE DTAVYYCAHPRYTWYDYWGQGTTVTVSSGGGGSGGGGSDKTHT CPPCPAPEAAGGPSVFLFPPKPKDTLMISRTPEVTCVVVDVSHEDPE VKFNWYVDGVEVHNAKTKPREEQYNSTYRVVSVLTVLHQDWLN GKEYKCKVSNKALGAPIEKTISKAKGQPREPQVYTLPPCRDELTKN QVSLWCLVKGFYPSDIAVEWESNGQPENNYKTTPPVLDSDGSFFL YSKLTVDKSRWQQGNVFSCSVMHEALHNHYTQKSLSLSPGK | 320 |
| monovalent anti-CEA aVH-Fc (knob) P124.021 | EVQLVESGGGLVQPGGSLRLSCAASGFNIKDTCIGWVRRAPGKEE ELVAAICPYKGYTRYADSVKGRFTISADTSKNTAYLQMNSLRAED TAVYYCANVAYSGGHYNYWGQGTTVTVSSGGGGSGGGGSDKTH TCPPCPAPEAAGGPSVFLFPPKPKDTLMISRTPEVTCVVVDVSHEDP EVKFNWYVDGVEVHNAKTKPREEQYNSTYRVVSVLTVLHQDWL NGKEYKCKVSNKALGAPIEKTISKAKGQPREPQVYTLPPCRDELTK NQVSLWCLVKGFYPSDIAVEWESNGQPENNYKTTPPVLDSDGSFF LYSKLTVDKSRWQQGNVFSCSVMHEALHNHYTQKSLSLSPGK | 321 |
| monovalent anti-CEA aVH-Fc (knob) P124.034 | EVQLVESGGGLVQPGGSLRLSCAASGFNIKDTCIGWVRRAPGKEE ELVAAICPYIGETRYADSVKGRFTISADTSKNTAYLQMNSLRAEDT AVYYCATVARKYNQYNYWGQGTTVTVSSGGGGSGGGGSDKTHT CPPCPAPEAAGGPSVFLFPPKPKDTLMISRTPEVTCVVVDVSHEDPE VKFNWYVDGVEVHNAKTKPREEQYNSTYRVVSVLTVLHQDWLN GKEYKCKVSNKALGAPIEKTISKAKGQPREPQVYTLPPCRDELTKN QVSLWCLVKGFYPSDIAVEWESNGQPENNYKTTPPVLDSDGSFFL YSKLTVDKSRWQQGNVFSCSVMHEALHNHYTQKSLSLSPGK | 322 |
| monovalent anti-CEA | EVQLVESGGGLVQPGGSLRLSCAASGFNIKDTCIGWVRRAPGKEE ELVAQICQYHGSTRYADSVKGRFTISADTSKNTAYLQMNSLRAED | 323 |

| Chain/clone | Sequence/Info | SEQ ID NO |
|---|---|---|
| SEQ ID NOs 248 to 405 | | |
| aVH-Fc (knob) P124.037 | TAVYYCAIVGQNYPVYNYWGQGTTVTVSSGGGGSGGGGSDKTH TCPPCPAPEAAGGPSVFLFPPKPKDTLMISRTPEVTCVVVDVSHEDP EVKFNWYVDGVEVHNAKTKPREEQYNSTYRVVSVLTVLHQDWL NGKEYKCKVSNKALGAPIEKTISKAKGQPREPQVYTLPPCRDELTK NQVSLWCLVKGFYPSDIAVEWESNGQPENNYKTTPPVLDSDGSFF LYSKLTVDKSRWQQGNVFSCSVMHEALHNHYTQKSLSLSPGK | |
| monovalent anti-CEA aVH-Fc (knob) P124.067 | EVQLVESGGGLVQPGGSLRLSCAASGFNIKDTCIGWVRRAPGKEE ELVAAICEYKGYTRYADSVKGRFTISADTSKNTAYLQMNSLRAED TAVYYCAISPVDQYYNYWGQGTTVTVSSGGGGSGGGGSDKTHT CPPCPAPEAAGGPSVFLFPPKPKDTLMISRTPEVTCVVVDVSHEDPE VKFNWYVDGVEVHNAKTKPREEQYNSTYRVVSVLTVLHQDWLN GKEYKCKVSNKALGAPIEKTISKAKGQPREPQVYTLPPCRDELTKN QVSLWCLVKGFYPSDIAVEWESNGQPENNYKTTPPVLDSDGSFFL YSKLTVDKSRWQQGNVFSCSVMHEALHNHYTQKSLSLSPGK | 324 |
| monovalent anti-CEA aVH-Fc (knob) P127.002 | EVQLVESGGGLVQPGGSLRLSCAASGFNIKDTCIGWVRRAPGKEE ELVASICKYTGKTRYADSVKGRFTISADTSKNTAYLQMNSLRAED TAVYYCAIVASGDGWYNYWGQGTTVTVSSGGGGSGGGGSDKTH TCPPCPAPEAAGGPSVFLFPPKPKDTLMISRTPEVTCVVVDVSHEDP EVKFNWYVDGVEVHNAKTKPREEQYNSTYRVVSVLTVLHQDWL NGKEYKCKVSNKALGAPIEKTISKAKGQPREPQVYTLPPCRDELTK NQVSLWCLVKGFYPSDIAVEWESNGQPENNYKTTPPVLDSDGSFF LYSKLTVDKSRWQQGNVFSCSVMHEALHNHYTQKSLSLSPGK | 325 |
| monovalent anti-CEA aVH-Fc (knob) P127.014 | EVQLVESGGGLVQPGGSLRLSCAASGFNIKDTCIGWVRRAPGKEE ELVAAICTYKGTTRYADSVKGRFTISADTSKNTAYLQMNSLRAED TAVYYCAIYSHYYDYYNYWGQGTTVTVSSGGGGSGGGGSDKTH TCPPCPAPEAAGGPSVFLFPPKPKDTLMISRTPEVTCVVVDVSHEDP EVKFNWYVDGVEVHNAKTKPREEQYNSTYRVVSVLTVLHQDWL NGKEYKCKVSNKALGAPIEKTISKAKGQPREPQVYTLPPCRDELTK NQVSLWCLVKGFYPSDIAVEWESNGQPENNYKTTPPVLDSDGSFF LYSKLTVDKSRWQQGNVFSCSVMHEALHNHYTQKSLSLSPGK | 326 |
| monovalent anti-CEA aVH-Fc (knob) P127.141 | EVQLVESGGGLVQPGGSLRLSCAASGFNIKDTCIGWVRRAPGKEE ELVAGICEYTGSTRYADSVKGRFTISADTSKNTAYLQMNSLRAED TAVYYCAIVSQSRSVYNYWGQGTTVTVSSGGGGSGGGGSDKTHT CPPCPAPEAAGGPSVFLFPPKPKDTLMISRTPEVTCVVVDVSHEDPE VKFNWYVDGVEVHNAKTKPREEQYNSTYRVVSVLTVLHQDWLN GKEYKCKVSNKALGAPIEKTISKAKGQPREPQVYTLPPCRDELTKN QVSLWCLVKGFYPSDIAVEWESNGQPENNYKTTPPVLDSDGSFFL YSKLTVDKSRWQQGNVFSCSVMHEALHNHYTQKSLSLSPGK | 327 |
| CD28 aVH binders (only aVH) | | |
| P023.001 | EVQLVESGGGLVQPGGSLRLSCAASGFNIKDTCIGWVRRAPGK EEELVAYICPSHGYTRYADSVKGRFTISADTSKNTAYLQMNSL RAEDTAVYYCADHKNTQWGYAYWGQGTTVTVSS | 328 |
| P020.051 | EVQLVESGGGLVQPGGSLRLSCAASGFNIKDTCIGWVRRAPGK EEELVAAICKTQGDTRYADSVKGRFTISADTSKNTAYLQMNSL RAEDTAVYYCAAANYDSPYTYWGQGTTVTVSS | 329 |
| P020.023 | EVQLVESGGGLVQPGGSLRLSCAASGFNIKDTCIGWARRAPGK EEELVAAICDYNGHTRYADSVKGRFTISADTSKNTAYLQMNSL RAEDTAVYYCAQSDYDSKYSYWGQGTTVTVSS | 330 |
| P020.010 | EVQLVESGGGLVQPGGSLRLSCAASGFNIKDTCIGWVRRAPGK EEELVAYICEGNGYTRYADSVKGRFTISADTSKNTAYLQMNSL RAEDTAVYYCAAEGKETYYYQYWGQGTTVTVSS | 331 |
| P020.027 | EVQLVESGGGLVQPGGSLRLSCAASGFNIKDTCIGWVRRAPGK EEELVAGICRDGGDTRYADSVKGRFTISADTSKNTAYLQMNSL RAEDTAVYYCAASDYDSYYAYWGQGTTVTVSS | 332 |
| P023.039 | EVQLVESGGGLVQPGGSLRLSCAASGFNIKDTCIGWVRRAPGK EEELVADICIKHGYTRYADSVKGRFTISADTSKNTAYLQMNSLR AEDTAVYYCADWTQSGYHYGYWGQGTTVTVSS | 333 |
| P020.017 | EVQLVESGGGLVQPGGSLRLSCAASGFNIKDTCIGWVRRAPGK EEELVAAICPDEGDTRYADSVKGRFTISADTSKNTAYLQMNSL RAEDTAVYYCAAAKYDDRYNYWGQGTTVTVSS | 334 |

| Chain/clone | Sequence/Info | SEQ ID NO |
|---|---|---|
| P019.020 | EVQLVESGGGLVQPGGSLRLSCAASGFNIKDSSTYIGWVRRAP GKEEELVAYIYCTQGETRYADSVKGRFTISCDTSKNTAYLQMN SLRAEDTAVYYCASWGGNYPYYYWGQGTTVTVSS | 335 |
| P023.017 | EVQLVESGGGLVQPGGSLRLSCAASGFNIKDTCIGWVRRAPGK EEELVARICGEYGSTRYADSVKGRFTISADTSKNTAYLQMNSL RAEDTAVYYCAAQPRYYDVYDYWGQGTTVTVSS | 336 |
| P020.057 | EVQLVESGGGLVQPGGSLRLSCAASGFNIKDTCIGWVRRAPGK EEELVAAICYTQGDTRYADSVKGRFTISADTSKNTAYLQMNSL RAEDTAVYYCAASQYDSYYTYWGQGTTVTVSS | 337 |
| P020.029 | EVQLVESGGGLVQPGGSLRLSCAASGFNIKDTCIGWVRRAPGK EEELVAGICEAGGDTRYADSVKGRFTISADTSKNTAYLQMNSL RAEDTAVYYCAESQQGSYYSYWGQGTTVTVSS | 338 |
| P020.065 | EVQLVESGGGLVQPGGSLRLSCAASGFNIKDTCIGWVRRAPGK EEELVAGICYTYGDTRYADSVKGRFTISADTSKNTAYLQMNSL RAEDTAVYYCASSEVDSYYSYWGQGTTVTVSS | 339 |
| P020.037 | EVQLVESGGGLVQPGGSLRLSCAASGFNIKDTCIGWVRRAPGK EEELVAAICDSGGDTRYADSVKGRFTISADTSKNTAYLQMNSL RAEDTAVYYCAASDYNSHYSYWGQGTTVTVSS | 340 |
| P020.034 | EVQLVESGGGLVQPGGSLRLSCAASGFNIKDTCIGWVRRAPGK EEELVAAICHHGGDTRYADSVKGRFTISADTSKNTAYLQMNSL RAEDTAVYYCAESQVDSYYSYWGQGTTVTVSS | 341 |
| P023.057 | EVQLVESGGGLVQPGGSLRLSCAASGFNIKDTCIGWVRRAPGK EEELVAEICGRYGSTRYADSVKGRFTISADTSKNTAYLQMNSL RAEDTAVYYCAAEHRYPGQYTYWGQGTTVTVSS | 342 |
| P020.042 | EVQLVESGGGLVQPGGSLRLSCAASGFNIKDTCIGWVRRAPGK EEELVAAICREAGDTRYADSVKGRFTISADTSKNTAYLQMNSL RAEDTAVYYCAAADYDSTYIYWGQGTTVTVSS | 343 |
| P020.035 | EVQLVESGGGLVQPGGSLRLSCAASGFNIKDTCIGWVRRAPGK EEELVADICGDDGHTRYADSVKGRFTISADTSKNTAYLQMNSL RAEDTAVYYCAYYSGSYYEYWGQGTTVTVSS | 344 |
| P020.077 | EVQLVESGGGLVQPGGSLRLSCAASGFNIKDTCIGWVRRAPGK EEELVAGICQHYGDTRYADSVKGRFTISADTSKNTAYLQMNSL RAEDTAVYYCATDDWIYPGYIYWGQGTTVTVSS | 345 |
| P020.063 | EVQLVESGGGLVQPGGSLRLSCAASGFNIKDTCIGWVRRAPGK EEELVAAICPEYGDTRYADSVKGRFTISADTSKNTAYLQMNSL RAEDTAVYYCASSDYDSAYSYWGQGTTVTVSS | 346 |
| Anti-CD28 aVH-Fc fusions | | |
| monovalent anti-CD28 aVH-Fc (knob) P023.001 | EVQLVESGGGLVQPGGSLRLSCAASGFNIKDTCIGWVRRAPGK EEELVAYICPSHGYTRYADSVKGRFTISADTSKNTAYLQMNSL RAEDTAVYYCADHKNTQWGYAYWGQGTTVTVSSGGGGSGGG GSDKTHTCPPCPAPEAAGGPSVFLFPPKPKDTLMISRTPEVTCVVV DVSHEDPEVKFNWYVDGVEVHNAKTKPREEQYNSTYRVVSVLTV LHQDWLNGKEYKCKVSNKALGAPIEKTISKAKGQPREPQVTLPP CRDELTKNQVSLWCLVKGFYPSDIAVEWESNGQPENNYKTTPPVL DSDGSFFLYSKLTVDKSRWQQGNVFSCSVMHEALHNHYTQKSLS LSPGK | 347 |
| monovalent anti-CD28 aVH-Fc (knob) P020.051 | EVQLVESGGGLVQPGGSLRLSCAASGFNIKDTCIGWVRRAPGK EEELVAAICKTQGDTRYADSVKGRFTISADTSKNTAYLQMNSL RAEDTAVYYCAAANYDSPYTYWGQGTTVTVSSGGGGSGGGGS DKTHTCPPCPAPEAAGGPSVFLFPPKPKDTLMISRTPEVTCVVVDV SHEDPEVKFNWYVDGVEVHNAKTKPREEQYNSTYRVVSVLTVLH QDWLNGKEYKCKVSNKALGAPIEKTISKAKGQPREPQVTLPPCR DELTKNQVSLWCLVKGFYPSDIAVEWESNGQPENNYKTTPPVLDS DGSFFLYSKLTVDKSRWQQGNVFSCSVMHEALHNHYTQKSLSLSP GK | 348 |
| monovalent anti-CD28 aVH-Fc | EVQLVESGGGLVQPGGSLRLSCAASGFNIKDTCIGWARRAPGK EEELVAAICDYNGHTRYADSVKGRFTISADTSKNTAYLQMNSL RAEDTAVYYCAQSDYDSKYSYWGQGTTVTVSSGGGGSGGGGS | 349 |

| Chain/clone | Sequence/Info | SEQ ID NO |
|---|---|---|
| (knob)<br>P020.023 | DKTHTCPPCPAPEAAGGPSVFLFPPKPKDTLMISRTPEVTCVVVDV<br>SHEDPEVKFNWYVDGVEVHNAKTKPREEQYNSTYRVVSVLTVLH<br>QDWLNGKEYKCKVSNKALGAPIEKTISKAKGQPREPQVYTLPPCR<br>DELTKNQVSLWCLVKGFYPSDIAVEWESNGQPENNYKTTPPVLDS<br>DGSFFLYSKLTVDKSRWQQGNVFSCSVMHEALHNHYTQKSLSLSP<br>GK | |
| monovalent<br>anti-CD28<br>aVH-Fc<br>(knob)<br>P020.010 | EVQLVESGGGLVQPGGSLRLSCAASGFNIKDTCIGWVRRAPGK<br>EEELVAYICEGNGYTRYADSVKGRFTISADTSKNTAYLQMNSL<br>RAEDTAVYYCAAEGKETYYYQYWGQGTTVTVSSGGGGSGGG<br>GSDKTHTCPPCPAPEAAGGPSVFLFPPKPKDTLMISRTPEVTCVVV<br>DVSHEDPEVKFNWYVDGVEVHNAKTKPREEQYNSTYRVVSVLTV<br>LHQDWLNGKEYKCKVSNKALGAPIEKTISKAKGQPREPQVYTLPP<br>CRDELTKNQVSLWCLVKGFYPSDIAVEWESNGQPENNYKTTPPVL<br>DSDGSFFLYSKLTVDKSRWQQGNVFSCSVMHEALHNHYTQKSLS<br>LSPGK | 350 |
| monovalent<br>anti-CD28<br>aVH-Fc<br>(knob)<br>P020.027 | EVQLVESGGGLVQPGGSLRLSCAASGFNIKDTCIGWVRRAPGK<br>EEELVAGICRDGGDTRYADSVKGRFTISADTSKNTAYLQMNSL<br>RAEDTAVYYCAASDYDSYYAYWGQGTTVTVSSGGGGSGGGGS<br>DKTHTCPPCPAPEAAGGPSVFLFPPKPKDTLMISRTPEVTCVVVDV<br>SHEDPEVKFNWYVDGVEVHNAKTKPREEQYNSTYRVVSVLTVLH<br>QDWLNGKEYKCKVSNKALGAPIEKTISKAKGQPREPQVYTLPPCR<br>DELTKNQVSLWCLVKGFYPSDIAVEWESNGQPENNYKTTPPVLDS<br>DGSFFLYSKLTVDKSRWQQGNVFSCSVMHEALHNHYTQKSLSLSP<br>GK | 351 |
| monovalent<br>anti-CD28<br>aVH-Fc<br>(knob)<br>P023.039 | EVQLVESGGGLVQPGGSLRLSCAASGFNIKDTCIGWVRRAPGK<br>EEELVADICIKHGYTRYADSVKGRFTISADTSKNTAYLQMNSLR<br>AEDTAVYYCADWTQSGYHYGYWGQGTTVTVSSGGGGSGGGG<br>SDKTHTCPPCPAPEAAGGPSVFLFPPKPKDTLMISRTPEVTCVVVD<br>VSHEDPEVKFNWYVDGVEVHNAKTKPREEQYNSTYRVVSVLTVL<br>HQDWLNGKEYKCKVSNKALGAPIEKTISKAKGQPREPQVYTLPPC<br>RDELTKNQVSLWCLVKGFYPSDIAVEWESNGQPENNYKTTPPVLD<br>SDGSFFLYSKLTVDKSRWQQGNVFSCSVMHEALHNHYTQKSLSLS<br>PGK | 352 |
| monovalent<br>anti-CD28<br>aVH-Fc<br>(knob)<br>P020.017 | EVQLVESGGGLVQPGGSLRLSCAASGFNIKDTCIGWVRRAPGK<br>EEELVAAICPDEGDTRYADSVKGRFTISADTSKNTAYLQMNSL<br>RAEDTAVYYCAAAKYDDRYNYWGQGTTVTVSSGGGGSGGGG<br>SDKTHTCPPCPAPEAAGGPSVFLFPPKPKDTLMISRTPEVTCVVVD<br>VSHEDPEVKFNWYVDGVEVHNAKTKPREEQYNSTYRVVSVLTVL<br>HQDWLNGKEYKCKVSNKALGAPIEKTISKAKGQPREPQVYTLPPC<br>RDELTKNQVSLWCLVKGFYPSDIAVEWESNGQPENNYKTTPPVLD<br>SDGSFFLYSKLTVDKSRWQQGNVFSCSVMHEALHNHYTQKSLSLS<br>PGK | 353 |
| monovalent<br>anti-CD28<br>aVH-Fc<br>(knob)<br>P019.020 | EVQLVESGGGLVQPGGSLRLSCAASGFNIKDSSTYIGWVRRAP<br>GKEEELVAYIYCTQGETRYADSVKGRFTISCDTSKNTAYLQMN<br>SLRAEDTAVYYCASWGGNYPYYYWGQGTTVTVSSGGGGSGG<br>GGSDKTHTCPPCPAPEAAGGPSVFLFPPKPKDTLMISRTPEVTCVV<br>VDVSHEDPEVKFNWYVDGVEVHNAKTKPREEQYNSTYRVVSVLT<br>VLHQDWLNGKEYKCKVSNKALGAPIEKTISKAKGQPREPQVYTLP<br>PCRDELTKNQVSLWCLVKGFYPSDIAVEWESNGQPENNYKTTPPV<br>LDSDGSFFLYSKLTVDKSRWQQGNVFSCSVMHEALHNHYTQKSL<br>SLSPGK | 354 |
| monovalent<br>anti-CD28<br>aVH-Fc<br>(knob)<br>P023.017 | EVQLVESGGGLVQPGGSLRLSCAASGFNIKDTCIGWVRRAPGK<br>EEELVARICGEYGSTRYADSVKGRFTISADTSKNTAYLQMNSL<br>RAEDTAVYYCAAQPRYYDVYDYWGQGTTVTVSSGGGGSGGGG<br>GSDKTHTCPPCPAPEAAGGPSVFLFPPKPKDTLMISRTPEVTCVVV<br>DVSHEDPEVKFNWYVDGVEVHNAKTKPREEQYNSTYRVVSVLTV<br>LHQDWLNGKEYKCKVSNKALGAPIEKTISKAKGQPREPQVYTLPP<br>CRDELTKNQVSLWCLVKGFYPSDIAVEWESNGQPENNYKTTPPVL<br>DSDGSFFLYSKLTVDKSRWQQGNVFSCSVMHEALHNHYTQKSLS<br>LSPGK | 355 |
| monovalent<br>anti-CD28<br>aVH-Fc<br>(knob)<br>P020.057 | EVQLVESGGGLVQPGGSLRLSCAASGFNIKDTCIGWVRRAPGK<br>EEELVAAICYTQGDTRYADSVKGRFTISADTSKNTAYLQMNSL<br>RAEDTAVYYCAASQYDSYYTYWGQGTTVTVSSGGGGSGGGGS<br>DKTHTCPPCPAPEAAGGPSVFLFPPKPKDTLMISRTPEVTCVVVDV<br>SHEDPEVKFNWYVDGVEVHNAKTKPREEQYNSTYRVVSVLTVLH | 356 |

| Chain/clone | Sequence/Info | SEQ ID NO |
|---|---|---|
| | QDWLNGKEYKCKVSNKALGAPIEKTISKAKGQPREPQVYTLPPCR DELTKNQVSLWCLVKGFYPSDIAVEWESNGQPENNYKTTPPVLDS DGSFFLYSKLTVDKSRWQQGNVFSCSVMHEALHNHYTQKSLSLSP GK | |
| monovalent anti-CD28 aVH-Fc (knob) P020.029 | EVQLVESGGGLVQPGGSLRLSCAASGFNIKDTCIGWVRRAPGK EEELVAGICEAGGDTRYADSVKGRFTISADTSKNTAYLQMNSL RAEDTAVYYCAESQQGSYYSYWGQGTTVTVSSGGGGSGGGGS DKTHTCPPCPAPEAAGGPSVFLFPPKPKDTLMISRTPEVTCVVVDV SHEDPEVKFNWYVDGVEVHNAKTKPREEQYNSTYRVVSVLTVLH QDWLNGKEYKCKVSNKALGAPIEKTISKAKGQPREPQVYTLPPCR DELTKNQVSLWCLVKGFYPSDIAVEWESNGQPENNYKTTPPVLDS DGSFFLYSKLTVDKSRWQQGNVFSCSVMHEALHNHYTQKSLSLSP GK | 357 |
| monovalent anti-CD28 aVH-Fc (knob) P020.065 | EVQLVESGGGLVQPGGSLRLSCAASGFNIKDTCIGWVRRAPGK EEELVAGICYTYGDTRYADSVKGRFTISADTSKNTAYLQMNSL RAEDTAVYYCASSEVDSYYSYWGQGTTVTVSSGGGGSGGGGS DKTHTCPPCPAPEAAGGPSVFLFPPKPKDTLMISRTPEVTCVVVDV SHEDPEVKFNWYVDGVEVHNAKTKPREEQYNSTYRVVSVLTVLH QDWLNGKEYKCKVSNKALGAPIEKTISKAKGQPREPQVYTLPPCR DELTKNQVSLWCLVKGFYPSDIAVEWESNGQPENNYKTTPPVLDS DGSFFLYSKLTVDKSRWQQGNVFSCSVMHEALHNHYTQKSLSLSP GK | 358 |
| monovalent anti-CD28 aVH-Fc (knob) P020.037 | EVQLVESGGGLVQPGGSLRLSCAASGFNIKDTCIGWVRRAPGK EEELVAAICDSGGDTRYADSVKGRFTISADTSKNTAYLQMNSL RAEDTAVYYCAASDYNSHYSYWGQGTTVTVSSGGGGSGGGGS DKTHTCPPCPAPEAAGGPSVFLFPPKPKDTLMISRTPEVTCVVVDV SHEDPEVKFNWYVDGVEVHNAKTKPREEQYNSTYRVVSVLTVLH QDWLNGKEYKCKVSNKALGAPIEKTISKAKGQPREPQVYTLPPCR DELTKNQVSLWCLVKGFYPSDIAVEWESNGQPENNYKTTPPVLDS DGSFFLYSKLTVDKSRWQQGNVFSCSVMHEALHNHYTQKSLSLSP GK | 359 |
| monovalent anti-CD28 aVH-Fc (knob) P020.034 | EVQLVESGGGLVQPGGSLRLSCAASGFNIKDTCIGWVRRAPGK EEELVAAICHHGGDTRYADSVKGRFTISADTSKNTAYLQMNSL RAEDTAVYYCAESQVDSYYSYWGQGTTVTVSSGGGGSGGGGS DKTHTCPPCPAPEAAGGPSVFLFPPKPKDTLMISRTPEVTCVVVDV SHEDPEVKFNWYVDGVEVHNAKTKPREEQYNSTYRVVSVLTVLH QDWLNGKEYKCKVSNKALGAPIEKTISKAKGQPREPQVYTLPPCR DELTKNQVSLWCLVKGFYPSDIAVEWESNGQPENNYKTTPPVLDS DGSFFLYSKLTVDKSRWQQGNVFSCSVMHEALHNHYTQKSLSLSP GK | 360 |
| monovalent anti-CD28 aVH-Fc (knob) P023.057 | EVQLVESGGGLVQPGGSLRLSCAASGFNIKDTCIGWVRRAPGK EEELVAEICGRYGSTRYADSVKGRFTISADTSKNTAYLQMNSL RAEDTAVYYCAAEHRYPGQYTYWGQGTTVTVSSGGGGSGGGG SDKTHTCPPCPAPEAAGGPSVFLFPPKPKDTLMISRTPEVTCVVVD VSHEDPEVKFNWYVDGVEVHNAKTKPREEQYNSTYRVVSVLTVL HQDWLNGKEYKCKVSNKALGAPIEKTISKAKGQPREPQVYTLPPC RDELTKNQVSLWCLVKGFYPSDIAVEWESNGQPENNYKTTPPVLD SDGSFFLYSKLTVDKSRWQQGNVFSCSVMHEALHNHYTQKSLSLS PGK | 361 |
| monovalent anti-CD28 aVH-Fc (knob) P020.042 | EVQLVESGGGLVQPGGSLRLSCAASGFNIKDTCIGWVRRAPGK EEELVAAICREAGDTRYADSVKGRFTISADTSKNTAYLQMNSL RAEDTAVYYCAAADYDSTYIYWGQGTTVTVSSGGGGSGGGGS DKTHTCPPCPAPEAAGGPSVFLFPPKPKDTLMISRTPEVTCVVVDV SHEDPEVKFNWYVDGVEVHNAKTKPREEQYNSTYRVVSVLTVLH QDWLNGKEYKCKVSNKALGAPIEKTISKAKGQPREPQVYTLPPCR DELTKNQVSLWCLVKGFYPSDIAVEWESNGQPENNYKTTPPVLDS DGSFFLYSKLTVDKSRWQQGNVFSCSVMHEALHNHYTQKSLSLSP GK | 362 |
| monovalent anti-CD28 aVH-Fc (knob) P020.035 | EVQLVESGGGLVQPGGSLRLSCAASGFNIKDTCIGWVRRAPGK EEELVADICGDDGHTRYADSVKGRFTISADTSKNTAYLQMNSL RAEDTAVYYCAYYSGSYYEYWGQGTTVTVSSGGGGSGGGGSD KTHTCPPCPAPEAAGGPSVFLFPPKPKDTLMISRTPEVTCVVVDVS HEDPEVKFNWYVDGVEVHNAKTKPREEQYNSTYRVVSVLTVLHQ DWLNGKEYKCKVSNKALGAPIEKTISKAKGQPREPQVYTLPPCRD ELTKNQVSLWCLVKGFYPSDIAVEWESNGQPENNYKTTPPVLDSD GSFFLYSKLTVDKSRWQQGNVFSCSVMHEALHNHYTQKSLSLSPG K | 363 |

-continued

SEQ ID NOs 248 to 405

| Chain/clone | Sequence/Info | SEQ ID NO |
|---|---|---|
| monovalent anti-CD28 aVH-Fc (knob) P020.077 | EVQLVESGGGLVQPGGSLRLSCAASGFNIKDTCIGWVRRAPGK EEELVAGICQHYGDTRYADSVKGRFTISADTSKNTAYLQMNSL RAEDTAVYYCATDDWIYPGYIYWGQGTTVTVSSGGGGSGGGG SDKTHTCPPCPAPEAAGGPSVFLFPPKPKDTLMISRTPEVTCVVVD VSHEDPEVKFNWYVDGVEVHNAKTKPREEQYNSTYRVVSVLTVL HQDWLNGKEYKCKVSNKALGAPIEKTISKAKGQPREPQVYTLPPC RDELTKNQVSLWCLVKGFYPSDIAVEWESNGQPENNYKTTPPVLD SDGSFFLYSKLTVDKSRWQQGNVFSCSVMHEALHNHYTQKSLSLS PGK | 364 |
| monovalent anti-CD28 aVH-Fc (knob) P020.063 | EVQLVESGGGLVQPGGSLRLSCAASGFNIKDTCIGWVRRAPGK EEELVAAICPEYGDTRYADSVKGRFTISADTSKNTAYLQMNSL RAEDTAVYYCASSDYDSAYSYWGQGTTVTVSSGGGGSGGGGS DKTHTCPPCPAPEAAGGPSVFLFPPKPKDTLMISRTPEVTCVVVDV SHEDPEVKFNWYVDGVEVHNAKTKPREEQYNSTYRVVSVLTVLH QDWLNGKEYKCKVSNKALGAPIEKTISKAKGQPREPQVYTLPPCR DELTKNQVSLWCLVKGFYPSDIAVEWESNGQPENNYKTTPPVLDS DGSFFLYSKLTVDKSRWQQGNVFSCSVMHEALHNHYTQKSLSLSP GK | 365 |
| aVH_H2_forward Primer (Y33C/Y52C) | GCA CCG GGT AAA GAA GAG GAA CTG GTT GCA 1 ATT TGT 2 3 4 GGT 5 ACC CGT TAT GCA GAT AGC GTG AAA GGT C<br>The primer according to the above primer sequence is a mixtures of primer sequences, wherein the sequences differ in the triplets indicated by a number.<br>Triplet 1 encodes for the amino acids as indicated by percentage as follows: R (20%) A (20%) (N, T, D, G, Y, E, Q, S, I, H, K each 5.45%.<br>Triplet 2 encodes for the amino acids as indicated by percentage as follows: P (30%) G (10%) (N, T, D, A, R, K, E, Q, Y, S, I, H each 5.0%).<br>Triplet 3 encodes for the amino acids as indicated by percentage as follows: T (20%) S (20%) (N, G, D, A, R, K, E, Q, Y, I, H each 5.45%).<br>Triplet 4 encodes for the amino acids as indicated by percentage as follows: N (20%) G (20%) (S, T, D, A, R, K, E, Q, Y, I, H each 5.45%).<br>Triplet 5 encodes for the amino acids as indicated by percentage as follows 5: S (20%) Y (20%) (N, T, D, A, R, K, E, Q, G, I, H each 5.45%). | 406 |
| aVH_H2_forward Primer (P52aC/A71C) | GCA CCG GGT AAA GAA GAG GAA CTG GTT GCA 1 ATT 2 TGC 3 4 GGT 5 ACC CGT TAT GCA GAT AGC GTG AAA GGT C<br>The primer according to the above primer sequence is a mixtures of primer sequences, wherein the sequences differ in the triplets indicated by a number.<br>Triplet 1 encodes for the amino acids as indicated by percentage as follows: R (20%) A (20%) (N, T, D, G, Y, E, Q, S, I, H, K each 5.45%).<br>Triplet 2 encodes for the amino acids as indicated by percentage as follows: Y (20%) S (20%) (N, A, D, G, R, K, E, Q, T, I, H each 5.45%).<br>Triplet 3 encodes for the amino acids as indicated by percentage as follows: T (20%) S (20%) (N, G, D, A, R, K, E, Q, Y, I, H each 5.45%).<br>Triplet 4 encodes for the amino acids as indicated by percentage as follows: N (20%) G (20%) (S, T, D, A, R, K, E, Q, Y, I, H each 5.45%).<br>Triplet 5 encodes for the amino acids as indicated by percentage as follows: S (20%) Y (20%) (N, T, D, A, R, K, E, Q, G, I, H each 5.45%). | 407 |
| H2 reverse constant primer | TGC AAC CAG TTC CTC TTC TTT ACC CGG TGC | 368 |
| aVH_H3_5_for_Primer_TNa | GCC GAG GAC ACG GCC GTA TAT TAC TGT GCG 1 2 2 2 2 2 TAC 3 TAC TGG GGG CAA GGA ACC ACC GTC ACC GTC<br>The primer according to the above primer sequence is a mixtures of primer sequences, wherein the sequences differ in the triplets indicated by a number.<br>Triplet 1 encodes for the amino acids as indicated by percentage as follows: A (20%) S (20%) (N, T, D, R, Y, K, E, Q, G, I, H each 5.45%).<br>Triplet 2 encodes for the amino acids as indicated by | 408 |

| Chain/clone | Sequence/Info | SEQ ID NO |
|---|---|---|
| | percentage as follows: (G, Y, S 15% each) (D, E, Q, N, A, I, V, H, P, R, K, T each 4.4%) (W 2%)<br>Triplet 3 encodes for the amino acids as indicated by percentage as follows: D (30%) (N, T, S, A, R, K, E, Q, G, I, Y each 6.36%). | |
| aVH_H3_6_for_Primer_TNa | GCC GAG GAC ACG GCC GTA TAT TAC TGT GCG 1 2 2 2 2 2 TAC 3 TAC TGG GGG CAA GGA ACC ACC GTC ACC GTC<br>The primer according to the above primer sequence is a mixtures of primer sequences, wherein the sequences differ in the triplets indicated by a number.<br>Triplet 1 encodes for the amino acids as indicated by percentage as follows: A (20%) S (20%) (N, T, D, R, Y, K, E, Q, G, I, H each 5.45%).<br>Triplet 2 encodes for the amino acids as indicated by percentage as follows: (G, Y, S 15% each) (D, E, Q, N, A, I, V, H, P, R, K, T each 4.4%) (W 2%).<br>Triplet 3 encodes for the amino acids as indicated by percentage as follows: D (30%) (N, T, S, A, R, K, E, Q, G, I, Y each 6.36%). | 409 |
| aVH_H3_7_for_Primer_TN | GCC GAG GAC ACG GCC GTA TAT TAC TGT GCG 1 2 2 2 2 2 TAC 3 TAC TGG GGG CAA GGA ACC ACC GTC ACC GTC<br>The primer according to the above primer sequence is a mixtures of primer sequences, wherein the sequences differ in the triplets indicated by a number.<br>Triplet 1 encodes for the amino acids as indicated by percentage as follows: 1: A (20%) S (20%) (N, T, D, R, Y, K, E, Q, G, I, H each 5.45%).<br>Triplet 2 encodes for the amino acids as indicated by percentage as follows: (G, Y, S 15% each) (D, E, Q, N, A, I, V, H, P, R, K, T each 4.4%) (W 2%).<br>Triplet 3 encodes for the amino acids as indicated by percentage as follows: D (30%) (N, T, S, A, R, K, E, Q, G, I, Y each 6.36%) | 410 |
| aVH_H3 reverse constant Primer | CGC ACA GTA ATA TAC GGC CGT GTC CTC GGC | 372 |
| fdseqlong prim | GAC GTT AGT AAA TGA ATT TTC TGT ATG AGG | 373 |
| LMB3 prim | CAG GAA ACA GCT ATG ACC ATG ATT AC | 374 |
| stabilization variants | | |
| Template(6H1) | EVQLVESGGGLVQPGGSLRLSCAASSFNIKDTYIGWVRRAPGKGT<br>ELVAYIQCYGGATRYADSVKGRFTISCDTSKNTAYLQMNSLRAED<br>TAVYYCAAPSEYFAYWGQGTTVTVSSGGGGSGGGGSDKTHTCPP<br>CPAPEAAGGPSVFLFPPKPKDTLMISRTPEVTCVVVDVSHEDPEVK<br>FNWYVDGVEVHNAKTKPREEQYNSTYRVVSVLTVLHQDWLNGK<br>EYKCKVSNKALGAPIEKTISKAKGQPREPQVYTLPPCRDELTKNQV<br>SLWCLVKGFYPSDIAVEWESNGQPENNYKTTPPVLDSDGSFFLYS<br>KLTVDKSRWQQGNVFSCSVMHEALHNHYTQKSLSLSPGK | 375 |
| 6H1_V5Q | EVQLQESGGGLVQPGGSLRLSCAASSFNIKDTYIGWVRRAPGKGT<br>ELVAYIQCYGGATRYADSVKGRFTISCDTSKNTAYLQMNSLRAED<br>TAVYYCAAPSEYFAYWGQGTTVTVSSGGGGSGGGGSDKTHTCPP<br>CPAPEAAGGPSVFLFPPKPKDTLMISRTPEVTCVVVDVSHEDPEVK<br>FNWYVDGVEVHNAKTKPREEQYNSTYRVVSVLTVLHQDWLNGK<br>EYKCKVSNKALGAPIEKTISKAKGQPREPQVYTLPPCRDELTKNQV<br>SLWCLVKGFYPSDIAVEWESNGQPENNYKTTPPVLDSDGSFFLYS<br>KLTVDKSRWQQGNVFSCSVMHEALHNHYTQKSLSLSPGK | 376 |
| 6H1_L11S | EVQLVESGGGSVQPGGSLRLSCAASSFNIKDTYIGWVRRAPGKGTE<br>LVAYIQCYGGATRYADSVKGRFTISCDTSKNTAYLQMNSLRAEDT<br>AVYYCAAPSEYFAYWGQGTTVTVSSGGGGSGGGGSDKTHTCPPC<br>PAPEAAGGPSVFLFPPKPKDTLMISRTPEVTCVVVDVSHEDPEVKF<br>NWYVDGVEVHNAKTKPREEQYNSTYRVVSVLTVLHQDWLNGKE<br>YKCKVSNKALGAPIEKTISKAKGQPREPQVYTLPPCRDELTKNQVS<br>LWCLVKGFYPSDIAVEWESNGQPENNYKTTPPVLDSDGSFFLYSK<br>LTVDKSRWQQGNVFSCSVMHEALHNHYTQKSLSLSPGK | 377 |

SEQ ID NOs 248 to 405

| Chain/clone | Sequence/Info | SEQ ID NO |
|---|---|---|
| 6H1_F27Y | EVQLVESGGGLVQPGGSLRLSCAASSYNIKDTYIGWVRRAPGKGT<br>ELVAYIQCYGGATRYADSVKGRFTISCDTSKNTAYLQMNSLRAED<br>TAVYYCAAPSEYFAYWGQGTTVTVSSGGGGSGGGGSDKTHTCPP<br>CPAPEAAGGPSVFLFPPKPKDTLMISRTPEVTCVVVDVSHEDPEVK<br>FNWYVDGVEVHNAKTKPREEQYNSTYRVVSVLTVLHQDWLNGK<br>EYKCKVSNKALGAPIEKTISKAKGQPREPQVYTLPPCRDELTKNQV<br>SLWCLVKGFYPSDIAVEWESNGQPENNYKTTPPVLDSDGSFFLYS<br>KLTVDKSRWQQGNVFSCSVMHEALHNHYTQKSLSLSPGK | 378 |
| 6H1_R39Q | EVQLVESGGGLVQPGGSLRLSCAASSFNIKDTYIGWVRQAPGKGT<br>ELVAYIQCYGGATRYADSVKGRFTISCDTSKNTAYLQMNSLRAED<br>TAVYYCAAPSEYFAYWGQGTTVTVSSGGGGSGGGGSDKTHTCPP<br>CPAPEAAGGPSVFLFPPKPKDTLMISRTPEVTCVVVDVSHEDPEVK<br>FNWYVDGVEVHNAKTKPREEQYNSTYRVVSVLTVLHQDWLNGK<br>EYKCKVSNKALGAPIEKTISKAKGQPREPQVYTLPPCRDELTKNQV<br>SLWCLVKGFYPSDIAVEWESNGQPENNYKTTPPVLDSDGSFFLYS<br>KLTVDKSRWQQGNVFSCSVMHEALHNHYTQKSLSLSPGK | 379 |
| 6H1_G44E | EVQLVESGGGLVQPGGSLRLSCAASSFNIKDTYIGWVRRAPGKETE<br>LVAYIQCYGGATRYADSVKGRFTISCDTSKNTAYLQMNSLRAEDT<br>AVYYCAAPSEYFAYWGQGTTVTVSSGGGGSGGGGSDKTHTCPPC<br>PAPEAAGGPSVFLFPPKPKDTLMISRTPEVTCVVVDVSHEDPEVKF<br>NWYVDGVEVHNAKTKPREEQYNSTYRVVSVLTVLHQDWLNGKE<br>YKCKVSNKALGAPIEKTISKAKGQPREPQVYTLPPCRDELTKNQVS<br>LWCLVKGFYPSDIAVEWESNGQPENNYKTTPPVLDSDGSFFLYSK<br>LTVDKSRWQQGNVFSCSVMHEALHNHYTQKSLSLSPGK | 380 |
| 6H1_T45E | EVQLVESGGGLVQPGGSLRLSCAASSFNIKDTYIGWVRRAPGKGE<br>ELVAYIQCYGGATRYADSVKGRFTISCDTSKNTAYLQMNSLRAED<br>TAVYYCAAPSEYFAYWGQGTTVTVSSGGGGSGGGGSDKTHTCPP<br>CPAPEAAGGPSVFLFPPKPKDTLMISRTPEVTCVVVDVSHEDPEVK<br>FNWYVDGVEVHNAKTKPREEQYNSTYRVVSVLTVLHQDWLNGK<br>EYKCKVSNKALGAPIEKTISKAKGQPREPQVYTLPPCRDELTKNQV<br>SLWCLVKGFYPSDIAVEWESNGQPENNYKTTPPVLDSDGSFFLYS<br>KLTVDKSRWQQGNVFSCSVMHEALHNHYTQKSLSLSPGK | 381 |
| 6H1_T45R | EVQLVESGGGLVQPGGSLRLSCAASSFNIKDTYIGWVRRAPGKGR<br>ELVAYIQCYGGATRYADSVKGRFTISCDTSKNTAYLQMNSLRAED<br>TAVYYCAAPSEYFAYWGQGTTVTVSSGGGGSGGGGSDKTHTCPP<br>CPAPEAAGGPSVFLFPPKPKDTLMISRTPEVTCVVVDVSHEDPEVK<br>FNWYVDGVEVHNAKTKPREEQYNSTYRVVSVLTVLHQDWLNGK<br>EYKCKVSNKALGAPIEKTISKAKGQPREPQVYTLPPCRDELTKNQV<br>SLWCLVKGFYPSDIAVEWESNGQPENNYKTTPPVLDSDGSFFLYS<br>KLTVDKSRWQQGNVFSCSVMHEALHNHYTQKSLSLSPGK | 382 |
| 6H1_R58Y | EVQLVESGGGLVQPGGSLRLSCAASSFNIKDTYIGWVRRAPGKGT<br>ELVAYIQCYGGATYYADSVKGRFTISCDTSKNTAYLQMNSLRAED<br>TAVYYCAAPSEYFAYWGQGTTVTVSSGGGGSGGGGSDKTHTCPP<br>CPAPEAAGGPSVFLFPPKPKDTLMISRTPEVTCVVVDVSHEDPEVK<br>FNWYVDGVEVHNAKTKPREEQYNSTYRVVSVLTVLHQDWLNGK<br>EYKCKVSNKALGAPIEKTISKAKGQPREPQVYTLPPCRDELTKNQV<br>SLWCLVKGFYPSDIAVEWESNGQPENNYKTTPPVLDSDGSFFLYS<br>KLTVDKSRWQQGNVFSCSVMHEALHNHYTQKSLSLSPGK | 383 |
| 6H1_A84P | EVQLVESGGGLVQPGGSLRLSCAASSFNIKDTYIGWVRRAPGKGT<br>ELVAYIQCYGGATRYADSVKGRFTISCDTSKNTAYLQMNSLRPED<br>TAVYYCAAPSEYFAYWGQGTTVTVSSGGGGSGGGGSDKTHTCPP<br>CPAPEAAGGPSVFLFPPKPKDTLMISRTPEVTCVVVDVSHEDPEVK<br>FNWYVDGVEVHNAKTKPREEQYNSTYRVVSVLTVLHQDWLNGK<br>EYKCKVSNKALGAPIEKTISKAKGQPREPQVYTLPPCRDELTKNQV<br>SLWCLVKGFYPSDIAVEWESNGQPENNYKTTPPVLDSDGSFFLYS<br>KLTVDKSRWQQGNVFSCSVMHEALHNHYTQKSLSLSPGK | 384 |
| 6H1_A84S | EVQLVESGGGLVQPGGSLRLSCAASSFNIKDTYIGWVRRAPGKGT<br>ELVAYIQCYGGATRYADSVKGRFTISCDTSKNTAYLQMNSLRSED<br>TAVYYCAAPSEYFAYWGQGTTVTVSSGGGGSGGGGSDKTHTCPP<br>CPAPEAAGGPSVFLFPPKPKDTLMISRTPEVTCVVVDVSHEDPEVK<br>FNWYVDGVEVHNAKTKPREEQYNSTYRVVSVLTVLHQDWLNGK<br>EYKCKVSNKALGAPIEKTISKAKGQPREPQVYTLPPCRDELTKNQV<br>SLWCLVKGFYPSDIAVEWESNGQPENNYKTTPPVLDSDGSFFLYS<br>KLTVDKSRWQQGNVFSCSVMHEALHNHYTQKSLSLSPGK | 385 |
| 6H1_V89T | EVQLVESGGGLVQPGGSLRLSCAASSFNIKDTYIGWVRRAPGKGT<br>ELVAYIQCYGGATRYADSVKGRFTISCDTSKNTAYLQMNSLRAED | 386 |

-continued

| SEQ ID NOs 248 to 405 | | |
|---|---|---|
| Chain/clone | Sequence/Info | SEQ ID NO |
| | TATYYCAAPSEYFAYWGQGTTVTVSSGGGGSGGGGSDKTHTCPP<br>CPAPEAAGGPSVFLFPPKPKDTLMISRTPEVTCVVVDVSHEDPEVK<br>FNWYVDGVEVHNAKTKPREEQYNSTYRVVSVLTVLHQDWLNGK<br>EYKCKVSNKALGAPIEKTISKAKGQPREPQVYTLPPCRDELTKNQV<br>SLWCLVKGFYPSDIAVEWESNGQPENNYKTTPPVLDSDGSFFLYS<br>KLTVDKSRWQQGNVFSCSVMHEALHNHYTQKSLSLSPGK | |
| 6H1_F(100-1)Y | EVQLVESGGGLVQPGGSLRLSCAASSFNIKDTYIGWVRRAPGKGT<br>ELVAYIQCYGGATRYADSVKGRFTISCDTSKNTAYLQMNSLRAED<br>TAVYYCAAPSEYYAYWGQGTTVTVSSGGGGSGGGGSDKTHTCPP<br>CPAPEAAGGPSVFLFPPKPKDTLMISRTPEVTCVVVDVSHEDPEVK<br>FNWYVDGVEVHNAKTKPREEQYNSTYRVVSVLTVLHQDWLNGK<br>EYKCKVSNKALGAPIEKTISKAKGQPREPQVYTLPPCRDELTKNQV<br>SLWCLVKGFYPSDIAVEWESNGQPENNYKTTPPVLDSDGSFFLYS<br>KLTVDKSRWQQGNVFSCSVMHEALHNHYTQKSLSLSPGK | 387 |
| 6H1_A101D | EVQLVESGGGLVQPGGSLRLSCAASSFNIKDTYIGWVRRAPGKGT<br>ELVAYIQCYGGATRYADSVKGRFTISCDTSKNTAYLQMNSLRAED<br>TAVYYCAAPSEYFDYWGQGTTVTVSSGGGGSGGGGSDKTHTCPP<br>CPAPEAAGGPSVFLFPPKPKDTLMISRTPEVTCVVVDVSHEDPEVK<br>FNWYVDGVEVHNAKTKPREEQYNSTYRVVSVLTVLHQDWLNGK<br>EYKCKVSNKALGAPIEKTISKAKGQPREPQVYTLPPCRDELTKNQV<br>SLWCLVKGFYPSDIAVEWESNGQPENNYKTTPPVLDSDGSFFLYS<br>KLTVDKSRWQQGNVFSCSVMHEALHNHYTQKSLSLSPGK | 388 |
| 6H1_T108Q | EVQLVESGGGLVQPGGSLRLSCAASSFNIKDTYIGWVRRAPGKGT<br>ELVAYIQCYGGATRYADSVKGRFTISCDTSKNTAYLQMNSLRAED<br>TAVYYCAAPSEYFAYWGQGTQVTVSSGGGGSGGGGSDKTHTCPP<br>CPAPEAAGGPSVFLFPPKPKDTLMISRTPEVTCVVVDVSHEDPEVK<br>FNWYVDGVEVHNAKTKPREEQYNSTYRVVSVLTVLHQDWLNGK<br>EYKCKVSNKALGAPIEKTISKAKGQPREPQVYTLPPCRDELTKNQV<br>SLWCLVKGFYPSDIAVEWESNGQPENNYKTTPPVLDSDGSFFLYS<br>KLTVDKSRWQQGNVFSCSVMHEALHNHYTQKSLSLSPGK | 389 |
| 6H1_combo | EVQLQESGGGSVQPGGSLRLSCAASSYNIKDTYIGWVRQAPGKETE<br>LVAYIQCYGGATYYADSVKGRFTISCDTSKNTAYLQMNSLRSEDT<br>ATYYCAAPSEYYDWGQGTQVTVSSGGGGSGGGGSDKTHTCPPC<br>PAPEAAGGPSVFLFPPKPKDTLMISRTPEVTCVVVDVSHEDPEVKF<br>NWYVDGVEVHNAKTKPREEQYNSTYRVVSVLTVLHQDWLNGKE<br>YKCKVSNKALGAPIEKTISKAKGQPREPQVYTLPPCRDELTKNQVS<br>LWCLVKGFYPSDIAVEWESNGQPENNYKTTPPVLDSDGSFFLYSK<br>LTVDKSRWQQGNVFSCSVMHEALHNHYTQKSLSLSPGK | 390 |
| 9B4 | EVQLVESGGGLVQPGGSLRLSCAASGFNIKDTCIGWVRRAPGKGT<br>ELVAEICQDIGYTRYADSVKGRFTISADTSKNTAYLQMNSLRAEDT<br>AVYYCAAVEVAEYFEYWGQGTTVTVSSGGGGSGGGGSDKTHTCP<br>PCPAPEAAGGPSVFLFPPKPKDTLMISRTPEVTCVVVDVSHEDPEV<br>KFNWYVDGVEVHNAKTKPREEQYNSTYRVVSVLTVLHQDWLNG<br>KEYKCKVSNKALGAPIEKTISKAKGQPREPQVYTLPPCRDELTKNQ<br>VSLWCLVKGFYPSDIAVEWESNGQPENNYKTTPPVLDSDGSFFLY<br>SKLTVDKSRWQQGNVFSCSVMHEALHNHYTQKSLSLSPGK | 391 |
| 9B4 var1 | EVQLVESGGGLVQPGGSLRLSCAASGFNIKDTCIGWVRRAPGKGT<br>ELVAEICQDIGYTRYADSVKGRFTISADTSKNTAYLQMNSLRAEDT<br>AVYYCAKVEVAEYFDYWGQGTTVTVSSGGGGSGGGGSDKTHTC<br>PPCPAPEAAGGPSVFLFPPKPKDTLMISRTPEVTCVVVDVSHEDPE<br>VKFNWYVDGVEVHNAKTKPREEQYNSTYRVVSVLTVLHQDWLN<br>GKEYKCKVSNKALGAPIEKTISKAKGQPREPQVYTLPPCRDELTKN<br>QVSLWCLVKGFYPSDIAVEWESNGQPENNYKTTPPVLDSDGSFFL<br>YSKLTVDKSRWQQGNVFSCSVMHEALHNHYTQKSLSLSPGK | 392 |
| 9B4 var2 | EVQLVESGGGLVQPGGSLRLSCAASGFNIKDTCIGWVRRAPGKEE<br>ELVAEICQDIGYTRYADSVKGRFTISADTSKNTAYLQMNSLRAEDT<br>AVYYCAAVEVAEYYEYWGQGTTVTVSSGGGGSGGGGSDKTHTC<br>PPCPAPEAAGGPSVFLFPPKPKDTLMISRTPEVTCVVVDVSHEDPE<br>VKFNWYVDGVEVHNAKTKPREEQYNSTYRVVSVLTVLHQDWLN<br>GKEYKCKVSNKALGAPIEKTISKAKGQPREPQVYTLPPCRDELTKN<br>QVSLWCLVKGFYPSDIAVEWESNGQPENNYKTTPPVLDSDGSFFL<br>YSKLTVDKSRWQQGNVFSCSVMHEALHNHYTQKSLSLSPGK | 393 |
| 9B4 var3 | EVQLVESGGGLVQPGGSLRLSCAASGFNIKDTCIGWVRRAPGKEE<br>ETVAEICQDIGYTRYADSVKGRFTISADTSKNTAYLQMNSLRAEDT<br>AVYYCAAVEVAEYYEYWGQGTTVTVSSGGGGSGGGGSDKTHTC<br>PPCPAPEAAGGPSVFLFPPKPKDTLMISRTPEVTCVVVDVSHEDPE<br>VKFNWYVDGVEVHNAKTKPREEQYNSTYRVVSVLTVLHQDWLN | 394 |

-continued

| Chain/clone | Sequence/Info | SEQ ID NO |
|---|---|---|
| | GKEYKCKVSNKALGAPIEKTISKAKGQPREPQVYTLPPCRDELTKN<br>QVSLWCLVKGFYPSDIAVEWESNGQPENNYKTTPPVLDSDGSFFL<br>YSKLTVDKSRWQQGNVFSCSVMHEALHNHYTQKSLSLSPGK | |
| 9B4 var4 | EVQLVESGGGLVQPGGSLRLSCAASGFNIKDTCIGWVRRAPGKER<br>ELVAEICQDIGYTRYADSVKGRFTISADTSKNTAYLQMNSLRAEDT<br>AVYYCAAVEVAEYYEYWGQGTTVTVSSGGGGSGGGGSDKTHTC<br>PPCPAPEAAGGPSVFLFPPKPKDTLMISRTPEVTCVVVDVSHEDPE<br>VKFNWYVDGVEVHNAKTKPREEQYNSTYRVVSVLTVLHQDWLN<br>GKEYKCKVSNKALGAPIEKTISKAKGQPREPQVYTLPPCRDELTKN<br>QVSLWCLVKGFYPSDIAVEWESNGQPENNYKTTPPVLDSDGSFFL<br>YSKLTVDKSRWQQGNVFSCSVMHEALHNHYTQKSLSLSPGK | 395 |
| 17B5 | EVQLVESGGGLVQPGGSLRLSCAASGFNIKDTCIGWVRRAPGKGT<br>ELVAYICAEHGHTRYADSVKGRFTISADTSKNTAYLQMNSLRAED<br>TAVYYCADTVYADPFEYWGQGTTVTVSSGGGGSGGGGSDKTHTC<br>PPCPAPEAAGGPSVFLFPPKPKDTLMISRTPEVTCVVVDVSHEDPE<br>VKFNWYVDGVEVHNAKTKPREEQYNSTYRVVSVLTVLHQDWLN<br>GKEYKCKVSNKALGAPIEKTISKAKGQPREPQVYTLPPCRDELTKN<br>QVSLWCLVKGFYPSDIAVEWESNGQPENNYKTTPPVLDSDGSFFL<br>YSKLTVDKSRWQQGNVFSCSVMHEALHNHYTQKSLSLSPGK | 396 |
| 17B5 var1 | EVQLVESGGGLVQPGGSLRLSCAASGFNIKDTCIGWVRRAPGKGT<br>ELVAYICAEHGHTRYADSVKGRFTISADTSKNTAYLQMNSLRAED<br>TAVYYCAKTVYADPFDYWGQGTTVTVSSGGGGSGGGGSDKTHT<br>CPPCPAPEAAGGPSVFLFPPKPKDTLMISRTPEVTCVVVDVSHEDPE<br>VKFNWYVDGVEVHNAKTKPREEQYNSTYRVVSVLTVLHQDWLN<br>GKEYKCKVSNKALGAPIEKTISKAKGQPREPQVYTLPPCRDELTKN<br>QVSLWCLVKGFYPSDIAVEWESNGQPENNYKTTPPVLDSDGSFFL<br>YSKLTVDKSRWQQGNVFSCSVMHEALHNHYTQKSLSLSPGK | 397 |
| 17B5 var2 | EVQLVESGGGLVQPGGSLRLSCAASGFNIKDTCIGWVRRAPGKEE<br>ELVAYICAEHGHTRYADSVKGRFTISADTSKNTAYLQMNSLRAED<br>TAVYYCADTVYADPYEYWGQGTTVTVSSGGGGSGGGGSDKTHT<br>CPPCPAPEAAGGPSVFLFPPKPKDTLMISRTPEVTCVVVDVSHEDPE<br>VKFNWYVDGVEVHNAKTKPREEQYNSTYRVVSVLTVLHQDWLN<br>GKEYKCKVSNKALGAPIEKTISKAKGQPREPQVYTLPPCRDELTKN<br>QVSLWCLVKGFYPSDIAVEWESNGQPENNYKTTPPVLDSDGSFFL<br>YSKLTVDKSRWQQGNVFSCSVMHEALHNHYTQKSLSLSPGK | 398 |
| 17B5 var3 | EVQLVESGGGLVQPGGSLRLSCAASGFNIKDTCIGWVRRAPGKEE<br>ETVAYICAEHGHTRYADSVKGRFTISADTSKNTAYLQMNSLRAED<br>TAVYYCADTVYADPYEYWGQGTTVTVSSGGGGSGGGGSDKTHT<br>CPPCPAPEAAGGPSVFLFPPKPKDTLMISRTPEVTCVVVDVSHEDPE<br>VKFNWYVDGVEVHNAKTKPREEQYNSTYRVVSVLTVLHQDWLN<br>GKEYKCKVSNKALGAPIEKTISKAKGQPREPQVYTLPPCRDELTKN<br>QVSLWCLVKGFYPSDIAVEWESNGQPENNYKTTPPVLDSDGSFFL<br>YSKLTVDKSRWQQGNVFSCSVMHEALHNHYTQKSLSLSPGK | 399 |
| 17B5 var4 | EVQLVESGGGLVQPGGSLRLSCAASGFNIKDTCIGWVRRAPGKER<br>ELVAYICAEHGHTRYADSVKGRFTISADTSKNTAYLQMNSLRAED<br>TAVYYCADTVYADPYEYWGQGTTVTVSSGGGGSGGGGSDKTHT<br>CPPCPAPEAAGGPSVFLFPPKPKDTLMISRTPEVTCVVVDVSHEDPE<br>VKFNWYVDGVEVHNAKTKPREEQYNSTYRVVSVLTVLHQDWLN<br>GKEYKCKVSNKALGAPIEKTISKAKGQPREPQVYTLPPCRDELTKN<br>QVSLWCLVKGFYPSDIAVEWESNGQPENNYKTTPPVLDSDGSFFL<br>YSKLTVDKSRWQQGNVFSCSVMHEALHNHYTQKSLSLSPGK | 400 |
| 20G3 | EVQLVESGGGLVQPGGSLRLSCAASGFNIKDTCIGWVRRAPGKGT<br>ELVAEICEDIGYTRYADSVKGRFTISADTSKNTAYLQMNSLRAEDT<br>AVYYCASTEVVTGFSYWGQGTTVTVSSGGGGSGGGGSDKTHTCP<br>PCPAPEAAGGPSVFLFPPKPKDTLMISRTPEVTCVVVDVSHEDPEV<br>KFNWYVDGVEVHNAKTKPREEQYNSTYRVVSVLTVLHQDWLNG<br>KEYKCKVSNKALGAPIEKTISKAKGQPREPQVYTLPPCRDELTKNQ<br>VSLWCLVKGFYPSDIAVEWESNGQPENNYKTTPPVLDSDGSFFLY<br>SKLTVDKSRWQQGNVFSCSVMHEALHNHYTQKSLSLSPGK | 401 |
| 20G3 var1 | EVQLVESGGGLVQPGGSLRLSCAASGFNIKDTCIGWVRRAPGKGT<br>ELVAEICEDIGYTRYADSVKGRFTISADTSKNTAYLQMNSLRAEDT<br>AVYYCAKTEVVTGFDYWGQGTTVTVSSGGGGSGGGGSDKTHTCP<br>PCPAPEAAGGPSVFLFPPKPKDTLMISRTPEVTCVVVDVSHEDPEV<br>KFNWYVDGVEVHNAKTKPREEQYNSTYRVVSVLTVLHQDWLNG<br>KEYKCKVSNKALGAPIEKTISKAKGQPREPQVYTLPPCRDELTKNQ<br>VSLWCLVKGFYPSDIAVEWESNGQPENNYKTTPPVLDSDGSFFLY<br>SKLTVDKSRWQQGNVFSCSVMHEALHNHYTQKSLSLSPGK | 402 |

-continued

| SEQ ID NOs 248 to 405 | | |
|---|---|---|
| Chain/clone | Sequence/Info | SEQ ID NO |
| 20G3 var2 | EVQLVESGGGLVQPGGSLRLSCAASGFNIKDTCIGWVRRAPGKEE ELVAEICEDIGYTRYADSVKGRFTISADTSKNTAYLQMNSLRAEDT AVYYCASTEVVTGYDYWGQGTTVTVSSGGGGSGGGGSDKTHTCP PCPAPEAAGGPSVFLFPPKPKDTLMISRTPEVTCVVVDVSHEDPEV KFNWYVDGVEVHNAKTKPREEQYNSTYRVVSVLTVLHQDWLNG KEYKCKVSNKALGAPIEKTISKAKGQPREPQVYTLPPCRDELTKNQ VSLWCLVKGFYPSDIAVEWESNGQPENNYKTTPPVLDSDGSFFLY SKLTVDKSRWQQGNVFSCSVMHEALHNHYTQKSLSLSPGK | 403 |
| 20G3 var3 | EVQLVESGGGLVQPGGSLRLSCAASGFNIKDTCIGWVRRAPGKEE ETVAEICEDIGYTRYADSVKGRFTISADTSKNTAYLQMNSLRAEDT AVYYCASTEVVTGYDYWGQGTTVTVSSGGGGSGGGGSDKTHTCP PCPAPEAAGGPSVFLFPPKPKDTLMISRTPEVTCVVVDVSHEDPEV KFNWYVDGVEVHNAKTKPREEQYNSTYRVVSVLTVLHQDWLNG KEYKCKVSNKALGAPIEKTISKAKGQPREPQVYTLPPCRDELTKNQ VSLWCLVKGFYPSDIAVEWESNGQPENNYKTTPPVLDSDGSFFLY SKLTVDKSRWQQGNVFSCSVMHEALHNHYTQKSLSLSPGK | 404 |
| 20G3 var4 | EVQLVESGGGLVQPGGSLRLSCAASGFNIKDTCIGWVRRAPGKER ELVAEICEDIGYTRYADSVKGRFTISADTSKNTAYLQMNSLRAEDT AVYYCASTEVVTGYDYWGQGTTVTVSSGGGGSGGGGSDKTHTCP PCPAPEAAGGPSVFLFPPKPKDTLMISRTPEVTCVVVDVSHEDPEV KFNWYVDGVEVHNAKTKPREEQYNSTYRVVSVLTVLHQDWLNG KEYKCKVSNKALGAPIEKTISKAKGQPREPQVYTLPPCRDELTKNQ VSLWCLVKGFYPSDIAVEWESNGQPENNYKTTPPVLDSDGSFFLY SKLTVDKSRWQQGNVFSCSVMHEALHNHYTQKSLSLSPGK | 405 |

SEQUENCE LISTING (442 sequences)

SEQ ID NO: 1 - protein, 19 aa, Artificial Sequence
  Description of Artificial Sequence: Synthetic construct
MDWTWRILFLVAAATGAHS

SEQ ID NO: 2 - protein, 19 aa, Artificial Sequence
  Description of Artificial Sequence: Synthetic construct
MGWSCIILFLVATATGVHS

SEQ ID NO: 3 - DNA, 2001 bp, Artificial Sequence
  Description of Artificial Sequence: Synthetic construct
ctctcgctgaagggcagccagacactgactgtctgcccagggtccgtccagccactcagcagtcagaccctcagggccagctccagcgcaggcactgacccccagctcctgctctaccgtgtggtgcggggcccccagctaggccggctgttccacgcccagcaggacagcacaggggaggccctggtgaacttcactcaggcagaggtctacgctgggaatattctgtatgagcatgagatgccccccgagcccttttgggaggcccatgataccctagagctccagctgtcctcgccgcctgcccgggacgtggccgccacccttgctgtggctgtgtcttttgaggctgcctgtccccagcaccccagccacctctggaagaacaaaggtctctgggtccccgagggccagcgggccaggatcaccgtggctgctctggatgcctccaatctcttggccagcgttccatcaccccagcgctcagagcatgatgtgctcttccaggtcacacagttccccagccggggccagctgttggtgtccgaggagcccctccatgctgggcagccccacttcctgcagtcccagctggctgcagggcagctagtgtatgcccacggcggtgggggcacccagcaggatggcttccactttcgtgcccacctccaggggccagcaggggcctccgtggctggaccccaaacctcagaggcctttgccatcacggtgagggatgtaaatgagcggccccctcagccacaggcctctgtcccactccggctcacccgaggctctcgtgcccccatctcccgggcccagctgagtgtggtggacccagactcagctcctggggagattgagtacgaggtccagcgggcaccccacaacggcttcctcagcctggtgggtggtggcctggggcccgtgacccgcttcacgcaagccgatgtggattcagggcggctggccttcgtggccaacgggagcagcgtggcaggcatcttccagctgagcatgtctgatggggccagcccacccctgcccatgtccctggctgtggacatcctaccatccgccatcgaggtgcagctgcgggcacccctggaggtgccccaagctttggggcgctcctcactgagccagcagcagctccgggtggtttcagatcgggaggagccagaggcagcataccgcctcatccagggaccccagtatgggcatctcctggtgggcgggcggcccacctcggccttcagccaattccagatagaccagggcgaggtggtctttgccttcaccaacttctcctcctctcatgaccacttcagagtcctggcactggctaggggtgtcaatgcatcagccgtagtgaacgtcactgtgagggctctgctgcatgtgtgggcaggtgggccatggccccagggtgccaccctgcgcctggaccccaccgtcctagatgctggcgagctggccaaccgcacaggcagtgtgccgcgcttccgcctcctggagggaccccggcatggccgcgtggtccgcgtgccccgagccaggacggagcccgggggcagccagctggtggagcagttcactcagcaggaccttgaggacgggaggctggggctggaggtgggcaggccagaggggagggcccccggccccgcaggtgacagtctcactctggagctgtgggcacagggcgtcccgcctgctgtggcctccctggactttgccactgagccttacaatgctgcccggccctacagcgtggccctgctcagtgtccccgaggccgcccggacggaagcagggaagccagagagcagcacccccacaggcgagccaggccccatggcatccagccctgagcccgctgtggccaagggaggcgtcgacgaacagttatattttcagggcggctcaggcctgaacgacatcttcgaggcccagaagatcgagtggcacgaggctcgagctcaccaccatcaccatcac

SEQ ID NO: 4 - protein, 667 aa, Artificial Sequence
  Description of Artificial Sequence: Synthetic construct
LSLKGSQTLTVCPGSVQPLSSQTLRASSSAGTDPQLLLYRVVRGPQLGRLFHAQQDSTGEALVNFTQAEVYAGNILYEHEMPPEPFWEAHDTLELQLSSPPARDVAATLAVAVSFEAACPQHPSHLWKNKGLWVPEGQRARITVAALDASNLLASVPSPQRSEHDVLFQVTQFPSRGQLLVSEEPLHAGQPHFLQSQLAAGQLVYAHGGGGTQQDGFHFRAHLQGPAGASVAGPQTSEAFAITVRDVNERPPQPQASVPLRLTRGSRAPISRAQLSVVDPDSAPGEIEYEVQRAPHNGFLSLVGGGLGPVTRFTQADVDSGRLAFVANGSSVAGIFQLSMSDGASPPLPMSLAVDILPSAIEVQLRAPLEVPQALGRSSLSQQQLRVVSDREEPEAAYRLIQGPQYGHLLVGGRPTSAFSQFQIDQGEVVFAFTNFSSSHDHFRVLALARGVNASAVVNVTVRALLHVWAGGPWPQGATLRLDPTVLDAGELANRTGSVPRFRLLEGPRHGRVVRVPRARTEPGGSQLVEQFTQQDLEDGRLGLEVGRPEGRAPGPAGDSLTLELWAQGVPPAVASLDFATEPYNAARPYSVALLSVPEAARTEAGKPESSTPTGEPGPMASSPEPAVAKGGVDEQLYFQGGSGLNDIFEAQKIEWHEARAHHHHHH

SEQ ID NO: 5 - DNA, 2691 bp, Artificial Sequence
  Description of Artificial Sequence: Synthetic construct
ggcctgaacgatatttttgaagcccagaaaatcgaatggcatgaggacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtggcggagggggatctggaggtggcggctccggaagcggcggaggcggatccttatattgggatgacctgaagagaaagttgtcggagaaactggacagcacagacttcaccggcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttt

SEQ ID NO: 6 - protein, 897 aa, Artificial Sequence
  Description of Artificial Sequence: Synthetic construct
GLNDIFEAQKIEWHEDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGGGGGSGGGGSGSGGGGSLYWDDLKRKLSEKLDSTDFTGTIKLLNENSYVPREAGSQKDENLALYVENQFREFKLSKVWRDQHFVKIQVKDSAQNSVIIVDKNGRLVYLVENPGGYVAYSKAATVTGKLVHANFGTKKDFEDLYTPVNGSIVIVRAGKITFAEKVANAESLNAIGVLIYMDQTKFPIVNAELSFFGHAHLGTGDPYTPGFPSFNHTQFPPSRSSGLPNIPVQTISRAAAEKLFGNMEGDCPSDWKTDSTCRMVTSESKNVKLTVSNVLKEIKILNIFGVIKGFVEPDHYVVVGAQRDAWGPGAAKSGVGTALLLKLAQMFSDMVLKDGFQPSRSIIFASWSAGDFGSVGATEWLEGYLSSLHLKAFTYINLDKAVLGTSNFKVSASPLLYTLIEKTMQNVKHPVTGQFLYQDSNWASKVEKLTLDNAAFPFLAYSGIPAVSFCFCEDTDYPYLGTTMDTYKELIERIPELNKVARAAAEVAGQFVIKLTHDVELNLDYERYNSQLLSFVRDLNQYRADIKEMGLSLQWLYSARGDFFRATSRLTTDFGNAEKTDRFVMKKLNDRVMRVEYHFLSPYVSPKESPFRHVFWGSGSHTLPALLENLKLRKQNNGAFNETLFRNQLALATWTIQGAANALSGDVWDIDNEF

SEQ ID NO: 7 - DNA, 687 bp, Artificial Sequence
  Description of Artificial Sequence: Synthetic construct
gacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccgga

SEQ ID NO: 8 - protein, 229 aa, Artificial Sequence
  Description of Artificial Sequence: Synthetic construct
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGKSG

SEQ ID NO: 9 - DNA, 1236 bp, Artificial Sequence
  Description of Artificial Sequence: Synthetic construct
atcacccaacaagacctagctccccagcagagagcggccccacaacaaaagaggtccagcccctcagagggattgtgtccacctggacaccatatctcagaagacggtagagattgcatctcctgcaaatatggacaggactatagcactcactggaatgacctccttttctgcttgcgctgcaccaggtgtgattcaggtgaagtggagctaagtccctgcaccacgaccagaaacacagtgtgtcagtgcgaagaaggcaccttccgggaagaagattctcctgagatgtgccggaagtgccgcacagggtgtcccagagggatggtcaaggtcggtgattgtacaccctggagtgacatcgaatgtgtccacaaagaatcaggtacaaagcacagtggggaagccccagctgtggaggagacggtgacctccagcccagggactcctgcctctgtcgacgaacagttatattttcagggcggctcacccaaatctgcagacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtggcgggtccggaggcctgaacgacatcttcgaggcccagaagattgaatggcacgag

SEQ ID NO: 10 - protein, 412 aa, Artificial Sequence
  Description of Artificial Sequence: Synthetic construct
ITQQDLAPQQRAAPQQKRSSPSEGLCPPGHHISEDGRDCISCKYGQDYSTHWNDLLFCLRCTRCDSGEVELSPCTTTRNTVCQCEEGTFREEDSPEMCRKCRTGCPRGMVKVGDCTPWSDIECVHKESGTKHSGEAPAVEETVTSSPGTPASVDEQLYFQGGSPKSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGGSGGLNDIFEAQKIEWHE

SEQ ID NO: 11 - DNA, 2043 bp, Artificial Sequence
  Description of Artificial Sequence: Synthetic construct
ctgcagcccggcgccgaggtgcccgtcgtgtgggctcaggagggcgctcctgcccagctgccatgcagccccaccatccctctccaagacctgtcccttctgaggcgggcaggggttacatggcaacaccagccagattctggaccccctgccgctgcaccaggccatccgttggcgcccgggcctcacccagctgcccccagtagctggggtcctagaccacgcagatacactgtgctctccgtcggccccggagggctgcggtctggcagacttccgctgcagccccgcgtgcagctcgacgaaaggggacggcaaagaggcgatttctcactgtggttgcgccctgcaaggcgggccgacgctggcgagtatagagccgcagtacatctgcgcgatagagccctcagctgtcggctgagacttcgcctggggcaggcttccatgaccgcctctccacccggaagtttgagggcgtcagactgggtcattctcaactgcagcttttcccggcctgatagaccagcctctgtccactggttccgcaataggggccaggggagagtgcccgttagagaaagtcctcaccatcacctggctgagagctttcttttcctgccacaagtgtccccgatggactcaggtccctggggctgtatcctcacataccgcgatggatttaacgtcagcattatgtataatctgactgtgttggggctggaacctccaacccccctcaccgtttacgctggcgcaggaagcagagtaggtctgccttgccggcttccagccggcgtggggacgagatctttcctgaccgctaagtggacacccccgggaggcggccccgacttgctcgtcactggtgacaacggcgattttaccctgcgccttgaggacgtgagtcaagcacaggcgggaacatatacttgtcatatccacctgcaggagcagcaactcaatgctaccgttacactggccataatcacggtgacccctaagagcttcgggtccccaggctctttgggaaagctgctctgcgaagtcacacccgtgtcaggtcaggagaggtttgtatggagctccctggatactccttctcaacggagtttcagcggcccatggcttgaagcacaggaggcccaactgttgagccagccctggcagtgtcagctctaccaaggggagagactgcttggagctgccgtgtacttcaccgaactgtcctctcctggcgcacagcgcagtgggagggctccaggcgctctccctgccggccacctgatcgagggcaggatggaccccaagagctgcgacaagacacacacgtgtccgccctgccctgccccagagctgttggggggtcccagcgtgttcctgtttcctccaaaacccaaggataccctcatgatctccagaacaccggaagtcacttgtgtggttgtggacgtctctcatgaggatcccgaagtgaaattcaactggtacgtagacggcgtggaggtccacaatgctaagaccaagcctcgcgaggaacagtataacagtacatacagagtggtttcagtgctgacggtccttcaccaggattggctgaatggaaaagagtataagtgcaaagtgagcaacaaggccttgccagcacccattgaaaaaaccatctccaaggccaaggggcaacctcgggagccacaggtttacacactccccccttctagagacgagctgactaaaaaccaagtgagtcttacctgcctggtgaagggcttttatccaagcgacattgctgtcgaatgggagtccaacggacagccggaaaataactacaaaacaactccccctgtgctcgattcagacggtagcttctttctgtactccaagttgaccgttgataaatctcgctggcaacagggcaatgtgttcagttgtagcgtcatgcatgaggccctgcacaaccattatacacagaagtccctctctctgtcaccagggggctccgggctgaatgatatctttgaagctcaaaagatagagtggcatgaa

SEQ ID NO: 12 - protein, 681 aa, Artificial Sequence
  Description of Artificial Sequence: Synthetic construct
LQPGAEVPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHLIEGRMDPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGGSGLNDIFEAQKIEWHE

SEQ ID NO: 13 - DNA, 360 bp, Artificial Sequence
  Description of Artificial Sequence: Synthetic construct
gaagttcagctggttgaaagcggtggtggtctggttcagcctggtggtagcctgcgtctgagctgtgcagcaagcggttttaatatcaaagatacctatattggttgggttcgtcgtgcaccgggtaaaggtgaagaactggttgcacgtatttatccgaccaatggttatacccgttatgcagatagcgtgaaaggtcgttttaccattagcgcagataccagcaaaaataccgcatatctgcagatgaatagcctgcgtgccgaggacacggccgtatattactgttcgcgttggggtggggatggtttttatgcaatggactactggggccaaggaaccctggtcaccgtctcgagt

SEQ ID NO: 14 - protein, 120 aa, Artificial Sequence
  Description of Artificial Sequence: Synthetic construct
EVQLVESGGGLVQPGGSLRLSCAASGFNIKDTYIGWVRRAPGKGEELVARIYPTNGYTRYADSVKGRFTISADTSKNTAYLQMNSLRAEDTAVYYCSRWGGDGFYAMDYWGQGTLVTVSS

SEQ ID NO: 15 - DNA, 26 bp, Artificial Sequence
  Description of Artificial Sequence: Synthetic primer
caggaaacagctatgaccatgattac

SEQ ID NO: 16 - DNA, 30 bp, Artificial Sequence
  Description of Artificial Sequence: Synthetic primer
gacgttagtaaatgaattttctgtatgagg

SEQ ID NO: 17 - DNA, 25 bp, Artificial Sequence
  Description of Artificial Sequence: Synthetic primer
cgcacagtaatatacggccgtgtcc

SEQ ID NO: 18 - DNA, 82 bp, Artificial Sequence
  Description of Artificial Sequence: Synthetic primer
  modified_base (29)..(31): This region may encompass one of the following codons: aaa, aag, cgt, cgc, cga, cgg, aga, agg
  modified_base (32)..(34): This region may encompass one of the following codons: ggt, ggc, gga, ggg, gat, gac, gaa, gag, gtt, gtc, gta, gtg, tct, tcc, tca, tcg, agt, agc, gct, gcc, gca, gcg, cct, ccc, cca, ccg, cgt, cgc, cga, cgg, aga, agg, tta, ttg, ctt, ctc, cta, ctg, act, acc, aca,
  modified_base (32)..(34): cont. from above: acg, tat, tac
  modified_base (35)..(37): This region may encompass one of the following codons: ggt, ggc, gga, ggg, tat, tac, tct, tcc, tca, tcg, agt, agc, gct, gcc, gca, gcg, gat, gac, act, acc, aca, acg, cgt, cgc, cga, cgg, aga, agg, cct, ccc, cca, ccg, tta, ttg, ctt, ctc, cta, ctg, gtt, gtc, gta,
  modified_base (35)..(37): cont. from above: gtg, aat, aac, tgg, ttt, ttc, att, atc, ata, gaa, gag
  modified_base (38)..(40): This region may encompass one of the following codons: ggt, ggc, gga, ggg, tat, tac, tct, tcc, tca, tcg, agt, agc, gct, gcc, gca, gcg, gat, gac, act, acc, aca, acg, cgt, cgc, cga, cgg, aga, agg, cct, ccc, cca, ccg, tta, ttg, ctt, ctc, cta, ctg, gtt, gtc, gta,
  modified_base (38)..(40): cont. from above: gtg, aat, aac, tgg, ttt, ttc, att, atc, ata, gaa, gag
  modified_base (41)..(43): This region may encompass one of the following codons: ggt, ggc, gga, ggg, gct, gcc, gca, gcg, tat, tac, cct, ccc, cca, ccg, tgg, tct, tcc, tca, tcg, agt, agc, gat, gac, act, acc, aca, acg
  modified_base (44)..(46): This region may encompass one of the following codons: ttt, ttc, tta, ttg, ctt, ctc, cta, ctg, atg, ggt, ggc, gga, ggg, att, atc, ata, tat, tac
  See specification as filed for detailed description of substitutions and preferred embodiments
cgaggacacggccgtatattactgtgcgnnnnnnnnnnnnnnnnnngactactggggccaaggaaccctggtcaccgtctcg

SEQ ID NO: 19 - DNA, 88 bp, Artificial Sequence
  Description of Artificial Sequence: Synthetic primer
  modified_base (29)..(31): This region may encompass one of the following codons: aaa, aag, cgt, cgc, cga, cgg, aga, agg
  modified_base (32)..(34): This region may encompass one of the following codons: ggt, ggc, gga, ggg, gat, gac, gaa, gag, gtt, gtc, gta, gtg, tct, tcc, tca, tcg, agt, agc, gct, gcc, gca, gcg, cct, ccc, cca, ccg, cgt, cgc, cga, cgg, aga, agg, tta, ttg, ctt, ctc, cta, ctg, act, acc, aca,
  modified_base (32)..(34): cont. from above: acg, tat, tac
  modified_base (35)..(37): This region may encompass one of the following codons: ggt, ggc, gga, ggg, tat, tac, tct, tcc, tca, tcg, agt, agc, gct, gcc, gca, gcg, gat, gac, act, acc, aca, acg, cgt, cgc, cga, cgg, aga, agg, cct, ccc, cca, ccg, tta, ttg, ctt, ctc, cta, ctg, gtt, gtc, gta,
  modified_base (35)..(37): cont. from above: gtg, aat, aac, tgg, ttt, ttc, att, atc, ata, gaa, gag
  modified_base (38)..(40): This region may encompass one of the following codons: ggt, ggc, gga, ggg, tat, tac, tct, tcc, tca, tcg, agt, agc, gct, gcc, gca, gcg, gat, gac, act, acc, aca, acg, cgt, cgc, cga, cgg, aga, agg, cct, ccc, cca, ccg, tta, ttg, ctt, ctc, cta, ctg, gtt, gtc, gta,
  modified_base (38)..(40): cont. from above: gtg, aat, aac, tgg, ttt, ttc, att, atc, ata, gaa, gag
  modified_base (41)..(43): This region may encompass one of the following codons: ggt, ggc, gga, ggg, tat, tac, tct, tcc, tca, tcg, agt, agc, gct, gcc, gca, gcg, gat, gac, act, acc, aca, acg, cgt, cgc, cga, cgg, aga, agg, cct, ccc, cca, ccg, tta, ttg, ctt, ctc, cta, ctg, gtt, gtc, gta,
  modified_base (41)..(43): cont. from above: gtg, aat, aac, tgg, ttt, ttc, att, atc, ata, gaa, gag
  modified_base (44)..(46): This region may encompass one of the following codons: ggt, ggc, gga, ggg, tat, tac, tct, tcc, tca, tcg, agt, agc, gct, gcc, gca, gcg, gat, gac, act, acc, aca, acg, cgt, cgc, cga, cgg, aga, agg, cct, ccc, cca, ccg, tta, ttg, ctt, ctc, cta, ctg, gtt, gtc, gta,
  modified_base (44)..(46): cont. from above: gtg, aat, aac, tgg, ttt, ttc, att, atc, ata, gaa, gag
  modified_base (47)..(49): a, c, t, g, unknown, or other
  modified_base (50)..(52): This region may encompass one of the following codons: ttt, ttc, tta, ttg, ctt, ctc, cta, ctg, atg, ggt, ggc, gga, ggg, att, atc, ata, tat, tac
  See specification as filed for detailed description of substitutions and preferred embodiments
cgaggacacggccgtatattactgtgcgnnnnnnnnnnnnnnnnnnnnnnnngactactggggccaaggaaccctggtcaccgtctcg

SEQ ID NO: 20 - DNA, 94 bp, Artificial Sequence
  Description of Artificial Sequence: Synthetic primer
  modified_base (29)..(31): This region may encompass one of the following codons: aaa, aag, cgt, cgc, cga, cgg, aga, agg
  modified_base (32)..(34): This region may encompass one of the following codons: ggt, ggc, gga, ggg, gat, gac, gaa, gag, gtt, gtc, gta, gtg, tct, tcc, tca, tcg, agt, agc, gct, gcc, gca, gcg, cct, ccc, cca, ccg, cgt, cgc, cga, cgg, aga, agg, tta, ttg, ctt, ctc, cta, ctg, act, acc, aca,
  modified_base (32)..(34): cont. from above: acg, tat, tac
  modified_base (35)..(37): This region may encompass one of the following codons: ggt, ggc, gga, ggg, tat, tac, tct, tcc, tca, tcg, agt, agc, gct, gcc, gca, gcg, gat, gac, act, acc, aca, acg, cgt, cgc, cga, cgg, aga, agg, cct, ccc, cca, ccg, tta, ttg, ctt, ctc, cta, ctg, gtt, gtc, gta,
  modified_base (35)..(37): cont. from above: gtg, aat, aac, tgg, ttt, ttc, att, atc, ata, gaa, gag
  modified_base (38)..(40): This region may encompass one of the following codons: ggt, ggc, gga, ggg, tat, tac, tct, tcc, tca, tcg, agt, agc, gct, gcc, gca, gcg, gat, gac, act, acc, aca, acg, cgt, cgc, cga, cgg, aga, agg, cct, ccc, cca, ccg, tta, ttg, ctt, ctc, cta, ctg, gtt, gtc, gta,
  modified_base (38)..(40): cont. from above: gtg, aat, aac, tgg, ttt, ttc, att, atc, ata, gaa, gag
  modified_base (41)..(43): This region may encompass one of the following codons: ggt, ggc, gga, ggg, tat, tac, tct, tcc, tca, tcg, agt, agc, gct, gcc, gca, gcg, gat, gac, act, acc, aca, acg, cgt, cgc, cga, cgg, aga, agg, cct, ccc, cca, ccg, tta, ttg, ctt, ctc, cta, ctg, gtt, gtc, gta,
  modified_base (41)..(43): cont. from above: gtg, aat, aac, tgg, ttt, ttc, att, atc, ata, gaa, gag
  modified_base (44)..(46): This region may encompass one of the following codons: ggt, ggc, gga, ggg, tat, tac, tct, tcc, tca, tcg, agt, agc, gct, gcc, gca, gcg, gat, gac, act, acc, aca, acg, cgt, cgc, cga, cgg, aga, agg, cct, ccc, cca, ccg, tta, ttg, ctt, ctc, cta, ctg, gtt, gtc, gta,
  modified_base (44)..(46): cont. from above: gtg, aat, aac, tgg, ttt, ttc, att, atc, ata, gaa, gag
  modified_base (47)..(49): This region may encompass one of the following codons: ggt, ggc, gga, ggg, tat, tac, tct, tcc, tca, tcg, agt, agc, gct, gcc, gca, gcg, gat, gac, act, acc, aca, acg, cgt, cgc, cga, cgg, aga, agg, cct, ccc, cca, ccg, tta, ttg, ctt, ctc, cta, ctg, gtt, gtc, gta,
  modified_base (47)..(49): cont. from above: gtg, aat, aac, tgg, ttt, ttc, att, atc, ata, gaa, gag
  modified_base (50)..(52): This region may encompass one of the following codons: ggt, ggc, gga, ggg, tat, tac, tct, tcc, tca, tcg, agt, agc, gct, gcc, gca, gcg, gat, gac, act, acc, aca, acg, cgt, cgc, cga, cgg, aga, agg, cct, ccc, cca, ccg, tta, ttg, ctt, ctc, cta, ctg, gtt, gtc, gta,
  modified_base (50)..(52): cont. from above: gtg, aat, aac, tgg, ttt, ttc, att, atc, ata, gaa, gag
  modified_base (53)..(55): This region may encompass one of the following codons: ggt, ggc, gga, ggg, gct, gcc, gca, gcg, tat, tac, cct, ccc, cca, ccg, tgg, tct, tcc, tca, tcg, agt, agc, gat, gac, act, acc, aca, acg
  modified_base (56)..(58): This region may encompass one of the following codons: ttt, ttc, tta, ttg, ctt, ctc, cta, ctg, atg, ggt, ggc, gga, ggg, att, atc, ata, tat, tac
  See specification as filed for detailed description of substitutions and preferred embodiments
cgaggacacggccgtatattactgtgcgnnnnnnnnnnnnnnnnnnnnnnnnnnnnnngactactggggccaaggaaccctggtcaccgtctcg

SEQ ID NO: 21 - DNA, 348 bp, Artificial Sequence
  Description of Artificial Sequence: Synthetic construct
gaagttcagctggttgaaagcggtggtggtctggttcagcctggtggtagcctgcgtctgagctgtgcagcaagcggttttaatatcaaagatacctatattggttgggttcgtcgtgcaccgggtaaaggtgaagaactggttgcacgtatttatccgaccaatggttatacccgttatgcagatagcgtgaaaggtcgttttaccattagcgcagataccagcaaaaataccgcatatctgcagatgaatagcctgcgtgccgaggacacggccgtatattactgtgcgaaatacgttcgttacttcgactactgggggcaaggaaccctggtcaccgtctcgagt

SEQ ID NO: 22 - protein, 116 aa, Artificial Sequence
  Description of Artificial Sequence: Synthetic construct
EVQLVESGGGLVQPGGSLRLSCAASGFNIKDTYIGWVRRAPGKGEELVARIYPTNGYTRYADSVKGRFTISADTSKNTAYLQMNSLRAEDTAVYYCAKYVRYFDYWGQGTLVTVSS

SEQ ID NO: 23 - DNA, 360 bp, Artificial Sequence
  Description of Artificial Sequence: Synthetic construct
gaagttcagctggttgaaagcggtggtggtctggttcagcctggtggtagcctgcgtctgagctgtgcagcaagcggttttaatatcaaagatacctatattggttgggttcgtcgtgcaccgggtaaaggtgaagaactggttgcacgtatttatccgaccaatggttatacccgttatgcagatagcgtgaaaggtcgttttaccattagcgcagataccagcaaaaataccgcatatctgcagatgaatagcctgcgtgccgaggacacggccgtatattactgtgcgaaatactacccgcgtacttacctggacttcgactactggggccaaggaaccctggtcaccgtctcgagt

SEQ ID NO: 24 - protein, 120 aa, Artificial Sequence
  Description of Artificial Sequence: Synthetic construct
EVQLVESGGGLVQPGGSLRLSCAASGFNIKDTYIGWVRRAPGKGEELVARIYPTNGYTRYADSVKGRFTISADTSKNTAYLQMNSLRAEDTAVYYCAKYYPRTYLDFDYWGQGTLVTVSS

SEQ ID NO: 25 - DNA, 348 bp, Artificial Sequence
  Description of Artificial Sequence: Synthetic construct
gaagttcagctggttgaaagcggtggtggtctggttcagcctggtggtagcctgcgtctgagctgtgcagcaagcggttttaatatcaaagatacctatattggttgggttcgtcgtgcaccgggtaaaggtgaagaactggttgcacgtatttatccgaccaatggttatacccgttatgcagatagcgtgaaaggtcgttttaccattagcgcagataccagcaaaaataccgcatatctgcagatgaatagcctgcgtgccgaggacacggccgtatattactgtgcgcgttactggtcttacttcgactactggggccaaggaaccctggtcaccgtctcgagt

SEQ ID NO: 26 - protein, 116 aa, Artificial Sequence
  Description of Artificial Sequence: Synthetic construct
EVQLVESGGGLVQPGGSLRLSCAASGFNIKDTYIGWVRRAPGKGEELVARIYPTNGYTRYADSVKGRFTISADTSKNTAYLQMNSLRAEDTAVYYCARYWSYFDYWGQGTLVTVSS

SEQ ID NO: 27 - DNA, 354 bp, Artificial Sequence
  Description of Artificial Sequence: Synthetic construct
gaagttcagctggttgaaagcggtggtggtctggttcagcctggtggtagcctgcgtctgagctgtgcagcaagcggttttaatatcaaagatacctatattggttgggttcgtcgtgcaccgggtaaaggtgaagaactggttgcacgtatttatccgaccaatggttatacccgttatgcagatagcgtgaaaggtcgttttaccattagcgcagataccagcaaaaataccgcatatctgcagatgaatagcctgcgtgccgaggacacggccgtatattactgtgcgaaacgttctcattactcttacttcgactactggggccaaggaaccctggtcaccgtctcgagt

SEQ ID NO: 28 - protein, 118 aa, Artificial Sequence
  Description of Artificial Sequence: Synthetic construct
EVQLVESGGGLVQPGGSLRLSCAASGFNIKDTYIGWVRRAPGKGEELVARIYPTNGYTRYADSVKGRFTISADTSKNTAYLQMNSLRAEDTAVYYCAKRSHYSYFDYWGQGTLVTVSS

SEQ ID NO: 29 - protein, 376 aa, Artificial Sequence
  Description of Artificial Sequence: Synthetic construct
EVQLVESGGGLVQPGGSLRLSCAASGFNIKDTYIGWVRRCPGKGTELVARIYPTNGYTRYADSVKGRFTISADTSKNTAYLQMNSLRAEDTCVYYCAKYVRYFDYWGQGTLVTVSSVDGGSPTPPTPGGGSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGKSGGLNDIFEAQKIEWHE

SEQ ID NO: 30 - protein, 376 aa, Artificial Sequence
  Description of Artificial Sequence: Synthetic construct
EVQLVESGGGLVQPGGSLRLSCAASGFNIKDTYIGWVRRAPGKGTELVARIYCTNGYTRYADSVKGRFTISCDTSKNTAYLQMNSLRAEDTAVYYCAKYVRYFDYWGQGTLVTVSSVDGGSPTPPTPGGGSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGKSGGLNDIFEAQKIEWHE

SEQ ID NO: 31 - protein, 376 aa, Artificial Sequence
  Description of Artificial Sequence: Synthetic construct
EVQLVESGGGLVQPGGSLRLSCAASGFNIKDTYIGWVRRAPGKGTELVCRIYPTNGYTRYADSVKGRFTCSADTSKNTAYLQMNSLRAEDTAVYYCAKYVRYFDYWGQGTLVTVSSVDGGSPTPPTPGGGSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGKSGGLNDIFEAQKIEWHE

SEQ ID NO: 32 - protein, 376 aa, Artificial Sequence
  Description of Artificial Sequence: Synthetic construct
EVQLVESGGGLVQPGGSLRLSCAASGFNIKDTYIGWVRRAPGKGTELVARIYPTNGYTRYADSVKGRFTISADTSKNTAYLQMNSLRAEDTAVYCCAKYVRYFDYWGQCTLVTVSSVDGGSPTPPTPGGGSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGKSGGLNDIFEAQKIEWHE

SEQ ID NO: 33 - protein, 376 aa, Artificial Sequence
  Description of Artificial Sequence: Synthetic construct
EVQLVESGGGCVQPGGSLRLSCAASGFNIKDTYIGWVRRAPGKGTELVARIYPTNGYTRYADSVKGRFTISADTSKNTAYLQMNSLRAEDTAVYYCAKYVRYFDYWGQGTLVCVSSVDGGSPTPPTPGGGSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGKSGGLNDIFEAQKIEWHE

SEQ ID NO: 34 - protein, 376 aa, Artificial Sequence
  Description of Artificial Sequence: Synthetic construct
EVQLVESGGGLVQPGGSLRLSCAASGFNIKDTYIGWVRRAPGKGTELVARIYPTNGYTRYADSVKGRFTISADTSKNTAYLQMNSCRAEDTAVYYCAKYVRYFDYWGQGTLVTCSSVDGGSPTPPTPGGGSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGKSGGLNDIFEAQKIEWHE

SEQ ID NO: 35 - protein, 376 aa, Artificial Sequence
  Description of Artificial Sequence: Synthetic construct
EVQLVCSGGGLVQPGGSLRLSCAASGFNIKDTYIGWVRRAPGKGTELVARIYPTNGYTRYADSVKGRFTISADTSKNTAYLQMNSLRAEDTAVYYCAKYVRYFDYWGQGCLVTVSSVDGGSPTPPTPGGGSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGKSGGLNDIFEAQKIEWHE

SEQ ID NO: 36 - protein, 376 aa, Artificial Sequence
  Description of Artificial Sequence: Synthetic construct
EVQLVESGGGLVQPGGSLRLSCAASGFNIKDTYIGWVRCAPGKGTELVARIYPTNGYTRYADSVKGRFTISADTSKNTAYLQMNSLRAEDTACYYCAKYVRYFDYWGQGTLVTVSSVDGGSPTPPTPGGGSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGKSGGLNDIFEAQKIEWHE

SEQ ID NO: 37 - protein, 376 aa, Artificial Sequence
  Description of Artificial Sequence: Synthetic construct
EVQLVESGGGLVQPGGSLRLSCAASGFNIKDTCIGWVRRAPGKGTELVARICPTNGYTRYADSVKGRFTISADTSKNTAYLQMNSLRAEDTAVYYCAKYVRYFDYWGQGTLVTVSSVDGGSPTPPTPGGGSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGKSGGLNDIFEAQKIEWHE

SEQ ID NO: 38 - protein, 376 aa, Artificial Sequence
  Description of Artificial Sequence: Synthetic construct
EVQLVESGGGLVQPGGSLRLSCAASGFNIKDTYIGWVRRAPGKGTELVARIYPTNGYTRYADSVKGRFTISADTSKNTAYLQMNSLRAEDTAVYYCASYVRYFDYWGQGTLVTVSSVDGGSPTPPTPGGGSADKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGKSGGLNDIFEAQKIEWHE

SEQ ID NO: 39 - DNA, 348 bp, Artificial Sequence
  Description of Artificial Sequence: Synthetic construct
gaagttcagctggttgaaagcggtggtggtctggttcagcctggtggtagcctgcgtctgagctgtgcagcaagcggttttaatatcaaagatacctatattggttgggttcgtcgtgcaccgggtaaaggtacagaactggttgcacgtatttattgcaccaatggttatacccgttatgcagatagcgtgaaaggtcgttttaccattagctgcgataccagcaaaaataccgcatatctgcagatgaatagcctgcgtgccgaggacacggccgtatattactgtgcgagctacgttcgttacttcgactactgggggcaaggaaccaccgtcaccgtctcgagt

SEQ ID NO: 40 - protein, 116 aa, Artificial Sequence
  Description of Artificial Sequence: Synthetic construct
EVQLVESGGGLVQPGGSLRLSCAASGFNIKDTYIGWVRRAPGKGTELVARIYCTNGYTRYADSVKGRFTISCDTSKNTAYLQMNSLRAEDTAVYYCASYVRYFDYWGQGTTVTVSS

SEQ ID NO: 41 - DNA, 348 bp, Artificial Sequence
  Description of Artificial Sequence: Synthetic construct
gaagttcagctggttgaaagcggtggtggtctggttcagcctggtggtagcctgcgtctgagctgtgcagcaagcagctttaatatcaaagatacctatattggttgggttcgtcgtgcaccgggtaaaggtacagaactggttgcacgtatttattgcaccaatggttatacccgttatgcagatagcgtgaaaggtcgttttaccattagctgcgataccagcaaaaataccgcatatctgcagatgaatagcctgcgtgccgaggacacggccgtatattactgtgcgagctacgttcgttacttcgactactgggggcaaggaaccaccgtcaccgtctcgagt

SEQ ID NO: 42 - protein, 116 aa, Artificial Sequence
  Description of Artificial Sequence: Synthetic construct
EVQLVESGGGLVQPGGSLRLSCAASSFNIKDTYIGWVRRAPGKGTELVARIYCTNGYTRYADSVKGRFTISCDTSKNTAYLQMNSLRAEDTAVYYCASYVRYFDYWGQGTTVTVSS

SEQ ID NO: 43 - DNA, 351 bp, Artificial Sequence
  Description of Artificial Sequence: Synthetic construct
gaagttcagctggttgaaagcggtggtggtctggttcagcctggtggtagcctgcgtctgagctgtgcagcaagcggttttaatatcaaagatagcacctatattggttgggttcgtcgtgcaccgggtaaaggtacagaactggttgcacgtatttattgcaccaatggttatacccgttatgcagatagcgtgaaaggtcgttttaccattagctgcgataccagcaaaaataccgcatatctgcagatgaatagcctgcgtgccgaggacacggccgtatattactgtgcgagctacgttcgttacttcgactactgggggcaaggaaccaccgtcaccgtctcgagt

SEQ ID NO: 44 - protein, 117 aa, Artificial Sequence
  Description of Artificial Sequence: Synthetic construct
EVQLVESGGGLVQPGGSLRLSCAASGFNIKDSTYIGWVRRAPGKGTELVARIYCTNGYTRYADSVKGRFTISCDTSKNTAYLQMNSLRAEDTAVYYCASYVRYFDYWGQGTTVTVSS

SEQ ID NO: 45 - DNA, 354 bp, Artificial Sequence
  Description of Artificial Sequence: Synthetic construct
gaagttcagctggttgaaagcggtggtggtctggttcagcctggtggtagcctgcgtctgagctgtgcagcaagcggttttaatatcaaagatagctctacctatattggttgggttcgtcgtgcaccgggtaaaggtacagaactggttgcacgtatttattgcaccaatggttatacccgttatgcagatagcgtgaaaggtcgttttaccattagctgcgataccagcaaaaataccgcatatctgcagatgaatagcctgcgtgccgaggacacggccgtatattactgtgcgagctacgttcgttacttcgactactgggggcaaggaaccaccgtcaccgtctcgagt

SEQ ID NO: 46 - protein, 118 aa, Artificial Sequence
  Description of Artificial Sequence: Synthetic construct
EVQLVESGGGLVQPGGSLRLSCAASGFNIKDSSTYIGWVRRAPGKGTELVARIYCTNGYTRYADSVKGRFTISCDTSKNTAYLQMNSLRAEDTAVYYCASYVRYFDYWGQGTTVTVSS

SEQ ID NO: 47 - DNA, 84 bp, Artificial Sequence
  Description of Artificial Sequence: Synthetic construct
  modified_base (34)..(36): This region may encompass one of the following codons: ggt, ggc, gga, ggg, tct, tcc, tca, tcg, agt, agc, aat, aac, act, acc, aca, acg, gat, gac, gct, gcc, gca, gcg, cgt, cgc, cga, cgg, aga, agg, gaa, gag, caa, cag, tat, tac, att, atc, ata, cat, cac
  modified_base (40)..(42): This region may encompass one of the following codons: tat, tac, gct, gcc, gca, gcg, aat, aac, act, acc, aca, acg, gat, gac, ggt, ggc, gga, ggg, cgt, cgc, cga, cgg, aga, agg, gaa, gag, caa, cag, tct, tcc, tca, tcg, agt, agc, att, atc, ata, cat, cac
  modified_base (43)..(45): This region may encompass one of the following codons: act, acc, aca, acg, tat, tac, aat, aac, gct, gcc, gca, gcg, gat, gac, ggt, ggc, gga, ggg, cgt, cgc, cga, cgg, aga, agg, gaa, gag, caa, cag, tct, tcc, tca, tcg, agt, agc, att, atc, ata, cat, cac
  modified_base (46)..(48): This region may encompass one of the following codons: gat, gac, tct, tcc, tca, tcg, agt, agc, aat, aac, act, acc, aca, acg, gct, gcc, gca, gcg, cgt, cgc, cga, cgg, aga, agg, gaa, gag, caa, cag, ggt, ggc, gga, ggg, tat, tac, att, atc, ata, cat, cac
  modified_base (55)..(57): This region may encompass one of the following codons: act, acc, aca, acg, aat, aac, gat, gac, tct, tcc, tca, tcg, agt, agc, gct, gcc, gca, gcg, cgt, cgc, cga, cgg, aga, agg, gaa, gag, caa, cag, ggt, ggc, gga, ggg, tat, tac, att, atc, ata, cat, cac
  See specification as filed for detailed description of substitutions and preferred embodiments
ttctgtacctttacccggtgcacgacgaacccannnaatnnnnnnnnntttgatnnnaaaaccgcttgctgcacagctcagacg

SEQ ID NO: 48 - DNA, 90 bp, Artificial Sequence
  Description of Artificial Sequence: Synthetic construct
  modified_base (40)..(42): This region may encompass one of the following codons: cgt, cgc, cga, cgg, aga, agg, gct, gcc, gca, gcg, aat, aac, act, acc, aca, acg, gat, gac, ggt, ggc, gga, ggg, tat, tac, gaa, gag, caa, cag, tct, tcc, tca, tcg, agt, agc, att, atc, ata, cat, cac, aaa, aag
  modified_base (46)..(48): This region may encompass one of the following codons: tat, tac, tct, tcc, tca, tcg, agt, agc, aat, aac, gct, gcc, gca, gcg, gat, gac, ggt, ggc, gga, ggg, cgt, cgc, cga, cgg, aga, agg, aaa, aag, gaa, gag, caa, cag, act, acc, aca, acg, att, atc, ata, cat, cac
  modified_base (52)..(54): This region may encompass one of the following codons: act, acc, aca, acg, tct, tcc, tca, tcg, agt, agc, aat, aac, ggt, ggc, gga, ggg, gat, gac, gct, gcc, gca, gcg, cgt, cgc, cga, cgg, aga, agg, aaa, aag, gaa, gag, caa, cag, tat, tac, att, atc, ata, cat, cac
  modified_base (55)..(57): This region may encompass one of the following codons: aat, aac, ggt, ggc, gga, ggg, tct, tcc, tca, tcg, agt, agc, act, acc, aca, acg, gat, gac, gct, gcc, gca, gcg, cgt, cgc, cga, cgg, aga, agg, aaa, aag, gaa, gag, caa, cag, tat, tac, att, atc, ata, cat, cac
  modified_base (61)..(63): This region may encompass one of the following codons: tct, tcc, tca, tcg, agt, agc, tat, tac, aat, aac, act, acc, aca, acg, gat, gac, gct, gcc, gca, gcg, cgt, cgc, cga, cgg, aga, agg, aaa, aag, gaa, gag, caa, cag, ggt, ggc, gga, ggg, att, atc, ata, cat, cac
  See specification as filed for detailed description of substitutions and preferred embodiments
gttcgtcgtgcaccgggtaaaggtacagaactggttgcannnattnnntgcnnnnnnggtnnnacccgttatgcagatagcgtgaaaggt

SEQ ID NO: 49 - DNA, 30 bp, Artificial Sequence
  Description of Artificial Sequence: Synthetic primer
cgcacagtaatatacggccgtgtcctcggc

SEQ ID NO: 50 - DNA, 81 bp, Artificial Sequence
  Description of Artificial Sequence: Synthetic primer
  modified_base (31)..(33): This region may encompass one of the following codons: gct, gcc, gca, gcg, tct, tcc, tca, tcg, agt, agc, aat, aac, act, acc, aca, acg, gat, gac, cgt, cgc, cga, cgg, aga, agg, tat, tac, aaa, aag, gaa, gag, caa, cag, ggt, ggc, gga, ggg, att, atc, ata, cat, cac
  modified_base (34)..(36): This region may encompass one of the following codons: ggt, ggc, gga, ggg, tat, tac, tct, tcc, tca, tcg, agt, agc, gat, gac, gaa, gag, caa, cag, aat, aac, gct, gcc, gca, gcg, att, atc, ata, gtt, gtc, gta, gtg, cat, cac, cct, ccc, cca, ccg, cgt, cgc, cga, cgg,
  modified_base (34)..(36): cont. from above: aga, agg, aaa, aag, act, acc, aca, acg, tgg
  modified_base (37)..(39): This region may encompass one of the following codons: ggt, ggc, gga, ggg, tat, tac, tct, tcc, tca, tcg, agt, agc, gat, gac, gaa, gag, caa, cag, aat, aac, gct, gcc, gca, gcg, att, atc, ata, gtt, gtc, gta, gtg, cat, cac, cct, ccc, cca, ccg, cgt, cgc, cga, cgg,
  modified_base (37)..(39): cont. from above: aga, agg, aaa, aag, act, acc, aca, acg, tgg
  modified_base (40)..(42): This region may encompass one of the following codons: ggt, ggc, gga, ggg, tat, tac, tct, tcc, tca, tcg, agt, agc, gat, gac, gaa, gag, caa, cag, aat, aac, gct, gcc, gca, gcg, att, atc, ata, gtt, gtc, gta, gtg, cat, cac, cct, ccc, cca, ccg, cgt, cgc, cga, cgg,
  modified_base (40)..(42): cont. from above: aga, agg, aaa, aag, act, acc, aca, acg, tgg
  modified_base (43)..(45): This region may encompass one of the following codons: ggt, ggc, gga, ggg, tat, tac, tct, tcc, tca, tcg, agt, agc, gat, gac, gaa, gag, caa, cag, aat, aac, gct, gcc, gca, gcg, att, atc, ata, gtt, gtc, gta, gtg, cat, cac, cct, ccc, cca, ccg, cgt, cgc, cga, cgg,
  modified_base (43)..(45): cont. from above: aga, agg, aaa, aag, act, acc, aca, acg, tgg
  modified_base (49)..(51): This region may encompass one of the following codons: gat, gac, cat, cac, aat, aac, act, acc, aca, acg, tct, tcc, tca, tcg, agt, agc, gct, gcc, gca, gcg, cgt, cgc, cga, cgg, aga, agg, aaa, aag, gaa, gag, caa, cag, ggt, ggc, gga, ggg, att, atc, ata, tat, tac
  See specification as filed for detailed description of substitutions and preferred embodiments
gccgaggacacggccgtatattactgtgcgnnnnnnnnnnnnnnnttcnnntactgggggcaaggaaccaccgtcaccgtc

SEQ ID NO: 51 - DNA, 84 bp, Artificial Sequence
  Description of Artificial Sequence: Synthetic primer
  modified_base (31)..(33): This region may encompass one of the following codons: gct, gcc, gca, gcg, tct, tcc, tca, tcg, agt, agc, aat, aac, act, acc, aca, acg, gat, gac, cgt, cgc, cga, cgg, aga, agg, tat, tac, aaa, aag, gaa, gag, caa, cag, ggt, ggc, gga, ggg, att, atc, ata, cat, cac
  modified_base (34)..(36): This region may encompass one of the following codons: gct, gcc, gca, gcg, tct, tcc, tca, tcg, agt, agc, aat, aac, act, acc, aca, acg, gat, gac, cgt, cgc, cga, cgg, aga, agg, tat, tac, aaa, aag, gaa, gag, caa, cag, ggt, ggc, gga, ggg, att, atc, ata, cat, cac
  modified_base (37)..(39): This region may encompass one of the following codons: ggt, ggc, gga, ggg, tat, tac, tct, tcc, tca, tcg, agt, agc, gat, gac, gaa, gag, caa, cag, aat, aac, gct, gcc, gca, gcg, att, atc, ata, gtt, gtc, gta, gtg, cat, cac, cct, ccc, cca, ccg, cgt, cgc, cga, cgg,
  modified_base (37)..(39): cont. from above: aga, agg, aaa, aag, act, acc, aca, acg, tgg
  modified_base (40)..(42): This region may encompass one of the following codons: ggt, ggc, gga, ggg, tat, tac, tct, tcc, tca, tcg, agt, agc, gat, gac, gaa, gag, caa, cag, aat, aac, gct, gcc, gca, gcg, att, atc, ata, gtt, gtc, gta, gtg, cat, cac, cct, ccc, cca, ccg, cgt, cgc, cga, cgg,
  modified_base (40)..(42): cont. from above: aga, agg, aaa, aag, act, acc, aca, acg, tgg
  modified_base (43)..(45): This region may encompass one of the following codons: ggt, ggc, gga, ggg, tat, tac, tct, tcc, tca, tcg, agt, agc, gat, gac, gaa, gag, caa, cag, aat, aac, gct, gcc, gca, gcg, att, atc, ata, gtt, gtc, gta, gtg, cat, cac, cct, ccc, cca, ccg, cgt, cgc, cga, cgg,
  modified_base (43)..(45): cont. from above: aga, agg, aaa, aag, act, acc, aca, acg, tgg
  modified_base (46)..(48): This region may encompass one of the following codons: ggt, ggc, gga, ggg, tat, tac, tct, tcc, tca, tcg, agt, agc, gat, gac, gaa, gag, caa, cag, aat, aac, gct, gcc, gca, gcg, att, atc, ata, gtt, gtc, gta, gtg, cat, cac, cct, ccc, cca, ccg, cgt, cgc, cga, cgg,
  modified_base (46)..(48): cont. from above: aga, agg, aaa, aag, act, acc, aca, acg, tgg
  modified_base (52)..(54): This region may encompass one of the following codons: gat, gac, cat, cac, aat, aac, act, acc, aca, acg, tct, tcc, tca, tcg, agt, agc, gct, gcc, gca, gcg, cgt, cgc, cga, cgg, aga, agg, aaa, aag, gaa, gag, caa, cag, ggt, ggc, gga, ggg, att, atc, ata, tat, tac
  See specification as filed for detailed description of substitutions and preferred embodiments
gccgaggacacggccgtatattactgtgcgnnnnnnnnnnnnnnnnnnttcnnntactgggggcaaggaaccaccgtcaccgtc

SEQ ID NO: 52 - DNA, 87 bp, Artificial Sequence
  Description of Artificial Sequence: Synthetic primer
  modified_base (31)..(33): This region may encompass one of the following codons: gct, gcc, gca, gcg, tct, tcc, tca, tcg, agt, agc, aat, aac, act, acc, aca, acg, gat, gac, cgt, cgc, cga, cgg, aga, agg, tat, tac, aaa, aag, gaa, gag, caa, cag, ggt, ggc, gga, ggg, att, atc, ata, cat, cac
  modified_base (34)..(36): This region may encompass one of the following codons: ggt, ggc, gga, ggg, tat, tac, tct, tcc, tca, tcg, agt, agc, gat, gac, gaa, gag, caa, cag, aat, aac, gct, gcc, gca, gcg, att, atc, ata, gtt, gtc, gta, gtg, cat, cac, cct, ccc, cca, ccg, cgt, cgc, cga, cgg,
  modified_base (34)..(36): cont. from above: aga, agg, aaa, aag, act, acc, aca, acg, tgg
  modified_base (37)..(39): This region may encompass one of the following codons: ggt, ggc, gga, ggg, tat, tac, tct, tcc, tca, tcg, agt, agc, gat, gac, gaa, gag, caa, cag, aat, aac, gct, gcc, gca, gcg, att, atc, ata, gtt, gtc, gta, gtg, cat, cac, cct, ccc, cca, ccg, cgt, cgc, cga, cgg,
  modified_base (37)..(39): cont. from above: aga, agg, aaa, aag, act, acc, aca, acg, tgg
  modified_base (40)..(42): This region may encompass one of the following codons: ggt, ggc, gga, ggg, tat, tac, tct, tcc, tca, tcg, agt, agc, gat, gac, gaa, gag, caa, cag, aat, aac, gct, gcc, gca, gcg, att, atc, ata, gtt, gtc, gta, gtg, cat, cac, cct, ccc, cca, ccg, cgt, cgc, cga, cgg,
  modified_base (40)..(42): cont. from above: aga, agg, aaa, aag, act, acc, aca, acg, tgg
  modified_base (43)..(45): This region may encompass one of the following codons: ggt, ggc, gga, ggg, tat, tac, tct, tcc, tca, tcg, agt, agc, gat, gac, gaa, gag, caa, cag, aat, aac, gct, gcc, gca, gcg, att, atc, ata, gtt, gtc, gta, gtg, cat, cac, cct, ccc, cca, ccg, cgt, cgc, cga, cgg,
  modified_base (43)..(45): cont. from above: aga, agg, aaa, aag, act, acc, aca, acg, tgg
  modified_base (46)..(48): This region may encompass one of the following codons: ggt, ggc, gga, ggg, tat, tac, tct, tcc, tca, tcg, agt, agc, gat, gac, gaa, gag, caa, cag, aat, aac, gct, gcc, gca, gcg, att, atc, ata, gtt, gtc, gta, gtg, cat, cac, cct, ccc, cca, ccg, cgt, cgc, cga, cgg,
  modified_base (46)..(48): cont. from above: aga, agg, aaa, aag, act, acc, aca, acg, tgg
  modified_base (49)..(51): This region may encompass one of the following codons: ggt, ggc, gga, ggg, tat, tac, tct, tcc, tca, tcg, agt, agc, gat, gac, gaa, gag, caa, cag, aat, aac, gct, gcc, gca, gcg, att, atc, ata, gtt, gtc, gta, gtg, cat, cac, cct, ccc, cca, ccg, cgt, cgc, cga, cgg,
  modified_base (49)..(51): cont. from above: aga, agg, aaa, aag, act, acc, aca, acg, tgg
  modified_base (55)..(57): This region may encompass one of the following codons: gat, gac, cat, cac, aat, aac, act, acc, aca, acg, tct, tcc, tca, tcg, agt, agc, gct, gcc, gca, gcg, cgt, cgc, cga, cgg, aga, agg, aaa, aag, gaa, gag, caa, cag, ggt, ggc, gga, ggg, att, atc, ata, tat, tac
  See specification as filed for detailed description of substitutions and preferred embodiments
gccgaggacacggccgtatattactgtgcgnnnnnnnnnnnnnnnnnnnnnttcnnntactgggggcaaggaaccaccgtcaccgtc

SEQ ID NO: 53 - DNA, 30 bp, Artificial Sequence
  Description of Artificial Sequence: Synthetic primer
ttctgtacctttacccggtgcacgacgaac

SEQ ID NO: 54 - DNA, 84 bp, Artificial Sequence
  Description of Artificial Sequence: Synthetic primer
  modified_base (34)..(36): This region may encompass one of the following codons: ggt, ggc, gga, ggg, tct, tcc, tca, tcg, agt, agc, aat, aac, act, acc, aca, acg, gat, gac, gct, gcc, gca, gcg, cgt, cgc, cga, cgg, aga, agg, gaa, gag, caa, cag, tat, tac, att, atc, ata, cat, cac
  modified_base (43)..(45): This region may encompass one of the following codons: act, acc, aca, acg, tat, tac, aat, aac, gct, gcc, gca, gcg, gat, gac, ggt, ggc, gga, ggg, cgt, cgc, cga, cgg, aga, agg, gaa, gag, caa, cag, tct, tcc, tca, tcg, agt, agc, att, atc, ata, cat, cac
  modified_base (46)..(48): This region may encompass one of the following codons: gat, gac, tct, tcc, tca, tcg, agt, agc, aat, aac, act, acc, aca, acg, gct, gcc, gca, gcg, cgt, cgc, cga, cgg, aga, agg, gaa, gag, caa, cag, ggt, ggc, gga, ggg, tat, tac, att, atc, ata, cat, cac
  modified_base (55)..(57): This region may encompass one of the following codons: act, acc, aca, acg, aat, aac, gat, gac, tct, tcc, tca, tcg, agt, agc, gct, gcc, gca, gcg, cgt, cgc, cga, cgg, aga, agg, gaa, gag, caa, cag, ggt, ggc, gga, ggg, tat, tac, att, atc, ata, cat, cac
  See specification as filed for detailed description of substitutions and preferred embodiments
ttctgtacctttacccggtgcacgacgaacccannnaatacannnnnntttgatnnnaaaaccgcttgctgcacagctcagacg

SEQ ID NO: 55 - DNA, 91 bp, Artificial Sequence
  Description of Artificial Sequence: Synthetic primer
  modified_base (40)..(42): This region may encompass one of the following codons: cgt, cgc, cga, cgg, aga, agg, gct, gcc, gca, gcg, aat, aac, act, acc, aca, acg, gat, gac, ggt, ggc, gga, ggg, tat, tac, gaa, gag, caa, cag, tct, tcc, tca, tcg, agt, agc, att, atc, ata, cat, cac, aaa, aag
  modified_base (49)..(51): This region may encompass one of the following codons: cct, ccc, cca, ccg, ggt, ggc, gga, ggg, aat, aac, act, acc, aca, acg, gat, gac, gct, gcc, gca, gcg, cgt, cgc, cga, cgg, aga, agg, aaa, aag, gaa, gag, caa, cag, tat, tac, tct, tcc, tca, tcg, agt, agc, att,
  modified_base (49)..(51): cont. from above: atc, ata, cat, cac
  modified_base (52)..(54): This region may encompass one of the following codons: act, acc, aca, acg, tct, tcc, tca, tcg, agt, agc, aat, aac, ggt, ggc, gga, ggg, gat, gac, gct, gcc, gca, gcg, cgt, cgc, cga, cgg, aga, agg, aaa, aag, gaa, gag, caa, cag, tat, tac, att, atc, ata, cat, cac
  modified_base (55)..(57): This region may encompass one of the following codons: aat, aac, ggt, ggc, gga, ggg, tct, tcc, tca, tcg, agt, agc, act, acc, aca, acg, gat, gac, gct, gcc, gca, gcg, cgt, cgc, cga, cgg, aga, agg, aaa, aag, gaa, gag, caa, cag, tat, tac, att, atc, ata, cat, cac
  modified_base (61)..(63): This region may encompass one of the following codons: tct, tcc, tca, tcg, agt, agc, tat, tac, aat, aac, act, acc, aca, acg, gat, gac, gct, gcc, gca, gcg, cgt, cgc, cga, cgg, aga, agg, aaa, aag, gaa, gag, caa, cag, ggt, ggc, gga, ggg, att, atc, ata, cat, cac
  See specification as filed for detailed description of substitutions and preferred embodiments
gttcgtcgtgcaccgggtaaaggtacagaactggttgcannnatttgtnnnnnnnnnggtnnnacccgttatgcagatagcgtgaaaggtc

SEQ ID NO: 56 - DNA, 348 bp, Artificial Sequence
  Description of Artificial Sequence: Synthetic construct
gaagttcagctggttgaaagcggtggtggtctggttcagcctggtggtagcctgcgtctgagctgtgcagcaagctcttttaatatcaaagatacctatattggttgggttcgtcgtgcaccgggtaaaggtacagaactggttgcatctattgactgcatctacggttacacccgttatgcagatagcgtgaaaggtcgttttaccattagctgcgataccagcaaaaataccgcatatctgcagatgaatagcctgcgtgccgaggacacggccgtatattactgtgcggctcagggttaccgtttgcattactgggggcaaggaaccaccgtcaccgtctcgagt

SEQ ID NO: 57 - protein, 116 aa, Artificial Sequence
  Description of Artificial Sequence: Synthetic construct
EVQLVESGGGLVQPGGSLRLSCAASSFNIKDTYIGWVRRAPGKGTELVASIDCIYGYTRYADSVKGRFTISCDTSKNTAYLQMNSLRAEDTAVYYCAAQGYRLHYWGQGTTVTVSS

SEQ ID NO: 58 - DNA, 354 bp, Artificial Sequence
  Description of Artificial Sequence: Synthetic construct
gaagttcagctggttgaaagcggtggtggtctggttcagcctggtggtagcctgcgtctgagctgtgcagcaagctcttttaatatcaaagatacctatattggttgggttcgtcgtgcaccgggtaaaggtacagaactggttgcagacatttactgctctgaaggttctacccgttatgcagatagcgtgaaaggtcgttttaccattagctgcgataccagcaaaaataccgcatatctgcagatgaatagcctgcgtgccgaggacacggccgtatattactgtgcggctgtttctgactacgttgttttctactactgggggcaaggaaccaccgtcaccgtctcgagt

SEQ ID NO: 59 - protein, 118 aa, Artificial Sequence
  Description of Artificial Sequence: Synthetic construct
EVQLVESGGGLVQPGGSLRLSCAASSFNIKDTYIGWVRRAPGKGTELVADIYCSEGSTRYADSVKGRFTISCDTSKNTAYLQMNSLRAEDTAVYYCAAVSDYVVFYYWGQGTTVTVSS

SEQ ID NO: 60 - DNA, 354 bp, Artificial Sequence
  Description of Artificial Sequence: Synthetic construct
gaagttcagctggttgaaagcggtggtggtctggttcagcctggtggtagcctgcgtctgagctgtgcagcaagctcttttaatatcaaagatacctatattggttgggttcgtcgtgcaccgggtaaaggtacagaactggttgcaggtatttactgcgaagctggtatcacccgttatgcagatagcgtgaaaggtcgttttaccattagctgcgataccagcaaaaataccgcatatctgcagatgaatagcctgcgtgccgaggacacggccgtatattactgtgcgggtaaaggtatcggtaactacttcgactactgggggcaaggaaccaccgtcaccgtctcgagt

SEQ ID NO: 61 - protein, 118 aa, Artificial Sequence
  Description of Artificial Sequence: Synthetic construct
EVQLVESGGGLVQPGGSLRLSCAASSFNIKDTYIGWVRRAPGKGTELVAGIYCEAGITRYADSVKGRFTISCDTSKNTAYLQMNSLRAEDTAVYYCAGKGIGNYFDYWGQGTTVTVSS

SEQ ID NO: 62 - DNA, 357 bp, Artificial Sequence
  Description of Artificial Sequence: Synthetic construct
gaagttcagctggttgaaagcggtggtggtctggttcagcctggtggtagcctgcgtctgagctgtgcagcaagcggttttaacatcaaagatggctatattgattgggttcgtcgtgcaccgggtaaaggtacagaactggttgcatctattgaatgcactaacggtcgtgctacccgttatgcagatagcgtgaaaggtcgttttaccattagctgcgataccagcaaaaataccgcatatctgcagatgaatagcctgcgggccgaggacacggccgtatattactgtgcgtacgctggtatcggttactacttctactactgggggcaaggaaccaccgtcaccgtctcgagt

SEQ ID NO: 63 - protein, 119 aa, Artificial Sequence
  Description of Artificial Sequence: Synthetic construct
EVQLVESGGGLVQPGGSLRLSCAASGFNIKDGYIDWVRRAPGKGTELVASIECTNGRATRYADSVKGRFTISCDTSKNTAYLQMNSLRAEDTAVYYCAYAGIGYYFYYWGQGTTVTVSS

SEQ ID NO: 64 - DNA, 351 bp, Artificial Sequence
  Description of Artificial Sequence: Synthetic construct
gaagttcagctggttgaaagcggtggtggtctggttcagcctggtggtagcctgcgtctgagctgtgcagcaagcggttttaacatcaaacagaactgtattgaatgggttcgtcgtgcaccaggtaaaggtacagaactggttgcaaacatttgtcatgacatcggttctacccgttatgcagatagcgtgaaaggtcgttttaccattagcgcagataccagcaaaaataccgcatatctgcagatgaatagcctgcgtgccgaggacacggccgtatattactgtgcggcttgggaacagaaaggtttcaactactgggggcaaggaaccaccgtcaccgtctcgagt

SEQ ID NO: 65 - protein, 117 aa, Artificial Sequence
  Description of Artificial Sequence: Synthetic construct
EVQLVESGGGLVQPGGSLRLSCAASGFNIKQNCIEWVRRAPGKGTELVANICHDIGSTRYADSVKGRFTISADTSKNTAYLQMNSLRAEDTAVYYCAAWEQKGFNYWGQGTTVTVSS

SEQ ID NO: 66 - DNA, 354 bp, Artificial Sequence
  Description of Artificial Sequence: Synthetic construct
gaagttcagctggttgaaagcggtggtggtctggttcagcctggtggtagcctgcgtctgagctgtgcagcaagcggttttgatatcaaacggtattgtattggctgggttcgtcgtgcaccgggtaaaggtacagaactggttgcaactatttgtaacactgacggttctacccgttatgcagatagcgtgaaaggtcgttttaccattagcgcagataccagcaaaaataccgcatatctgcagatgaatagcctgcgtgccgaggacacggccgtatattactgtgcgtacgaagaatgggaccagtacttccattactgggggcaaggaaccaccgtcaccgtctcgagt

SEQ ID NO: 67 - DNA, 357 bp, Artificial Sequence
  Description of Artificial Sequence: Synthetic construct
gaagttcagctggttgaaagcggtggtggtctggttcagcctggtggtagcctgcgtctgagctgtgcagcaagcggttttaatatcaaagatagcacctatattggttgggttcgtcgtgcaccgggtaaaggtacagaactggttgcatacatttcttgctacgacggtgacacccgttatgcagatagcgtgaaaggtcgttttaccattagctgcgataccagcaaaaataccgcatatctgcagatgaatagcctgcgtgccgaggacacggccgtatattactgtgcggaatactactactaccatggtttcgcttactgggggcaaggaaccaccgtcaccgtctcgagt

SEQ ID NO: 68 - DNA, 351 bp, Artificial Sequence
  Description of Artificial Sequence: Synthetic construct
gaagttcagctggttgaaagcggtggtggtctggttcagcctggtggtagcctgcgtctgagctgtgcagcaagcggttttaacatcaaagattattgtattggctgggttcgtcgtgcaccgggtaaaggtacagaactggttgcatctatttgtccggaaggtggttacacccgttatgcagatagcgtgaaaggtcgctttaccattagcgcagataccagcaaaaataccgcatatctgcagatgaatagcctgcgtgccgaggacacggccgtatattactgtgcgtactacggtgtttacggtttcgaatactgggggcaaggaaccaccgtcaccgtctcgagt

SEQ ID NO: 69 - DNA, 354 bp, Artificial Sequence
  Description of Artificial Sequence: Synthetic construct
gaagttcagctggttgaaagcggtggtggtctggttcagcctggtggtagcctgcgtctgagctgtgcagcaagctcttttaatatcaaagatacctatattggttgggttcgtcgtgcaccgggtaaaggtacagaactggttgcagctatttcttgctctactggtgacacccgttatgcagatagcgtgaaaggtcgttttaccattagctgcgataccagcaaaaataccgcatatctgcagatgaatagcctgcgtgccgaggacacggccgtatattactgtgcggctcaggacccgtggtacccgttctactactgggggcaaggaaccaccgtcaccgtctcgagt

SEQ ID NO: 70 - DNA, 354 bp, Artificial Sequence
  Description of Artificial Sequence: Synthetic construct
gaagttcagctggttgaaagcggtggtggtctggttcagcctggtggtagcctgcgtctgagctgtgcagcaagcggttttaatatcaaagatagcacctatattggttgggttcgtcgtgcaccgggtaaaggtacagaactggttgcagctattgactgctctggtggttacacccgttatgcagatagcgtgaaaggtcgttttaccattagctgcgataccagcaaaaataccgcatatctgcagatgaatagcctgcgtgccgaggacacggccgtatattactgtgcgtcttactactactacactttcgaatactgggggcaaggaaccaccgtcaccgtctcgagt

SEQ ID NO: 71 - DNA, 354 bp, Artificial Sequence
  Description of Artificial Sequence: Synthetic construct
gaagttcagctggttgaaagcggtggtggtctggttcagcctggtggtagcctgcgtctgagctgtgcagcaagctcttttaatatcaaagatacctatattggttgggttcgtcgtgcaccgggtaaaggtacagaactggttgcagctattgactgctctaacggtgacacccgttatgcagatagcgtgaaaggtcgttttaccattagctgcgataccagcaaaaataccgcatatctgcagatgaatagcctgcgtgccgaggacacggccgtatattactgtgcggaacattactaccattacggtttcatctactgggggcaaggaaccaccgtcaccgtctcgagt

SEQ ID NO: 72 - DNA, 357 bp, Artificial Sequence
  Description of Artificial Sequence: Synthetic construct
gaagttcagctggttgaaagcggtggtggtctggttcagcctggtggtagcctgcgtctgagctgtgcagcaagcggttttaatatcaaagatagcacctatattggttgggttcgtcgtgcaccgggtaaaggtacagaactggttgcaatcatttcttgcactgacggtgagacccgttatgcagatagcgtgaaaggtcgttttaccattagctgcaataccagcaaaaataccgcatatctgcagatgaatagcctgcgtgccgaggacacggccgtatattactgtgcggaccattactactaccatggtttcgcttactgggggcaaggaaccaccgtcaccgtctcgagt

SEQ ID NO: 73 - DNA, 1128 bp, Artificial Sequence
  Description of Artificial Sequence: Synthetic construct
gaagttcagctggttgaaagcggtggtggtctggttcagcctggtggtagcctgcgtctgagctgtgcagcaagcggttttaatatcaaagatacctatattggttgggttcgtcgtgcaccgggtaaaggtacagaactggttgcacgtatttatccgaccaatggttatacccgttatgcagatagcgtgaaaggtcgttttaccattagcgcagataccagcaaaaataccgcatatctgcagatgaatagcctgcgtgccgaggacacggccgtatattactgtgcgagctacgttcgttacttcgactactgggggcaaggaaccctggtcaccgtctcgagtgtcgacggtggtagtccgacacctccgacacccgggggtggttctgcagacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatccggaggcctgaacgacatcttcgaggcccagaagattgaatggcacgag

SEQ ID NO: 74 - DNA, 681 bp, Artificial Sequence
  Description of Artificial Sequence: Synthetic construct
gacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccgcttcacgcagaagagcctctccctgtctccgggtaaa

SEQ ID NO: 75 - DNA, 318 bp, Artificial Sequence
  Description of Artificial Sequence: Synthetic construct
acggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 76 - DNA, 354 bp, Artificial Sequence
  Description of Artificial Sequence: Synthetic construct
gaagttcagctggttgaaagcggtggtggtctggttcagcctggtggtagcctgcgtctgagctgtgcagcaagcggttttaatatcaaagatacctgtattggttgggttcgtcgtgcaccgggtaaaggtacagaactggttgcagaaatttgtactgacatcggttacacccgttatgcagatagcgtgaaaggtcgttttaccattagcgcagataccagcaaaaataccgcatatctgcagatgaatagcctgcgtgccgaggacacggccgtatattactgtgcggctggtgaaggttcttctggtttccattactgggggcaaggaaccaccgtcaccgtctcgagt

SEQ ID NO: 77 - protein, 118 aa, Artificial Sequence
  Description of Artificial Sequence: Synthetic construct
EVQLVESGGGLVQPGGSLRLSCAASGFNIKDTCIGWVRRAPGKGTELVAEICTDIGYTRYADSVKGRFTISADTSKNTAYLQMNSLRAEDTAVYYCAAGEGSSGFHYWGQGTTVTVSS

SEQ ID NO: 78 - DNA, 354 bp, Artificial Sequence
  Description of Artificial Sequence: Synthetic construct
gaagttcagctggttgaaagcggtggtggtctggttcagcctggtggtagcctgcgtctgagctgtgcagcaagcggttttaatatcaaagatacctgtattggttgggttcgtcgtgcaccgggtaaaggtacagaactggttgcagaaatttgtcaggacatcggttacacccgttatgcagatagcgtgaaaggtcgttttaccattagcgcagataccagcaaaaataccgcatatctgcagatgaatagcctgcgtgccgaggacacggccgtatattactgtgcggctgacgaatctgttgacaacttcaaatactgggggcaaggaaccaccgtcaccgtctcgagt

SEQ ID NO: 79 - protein, 118 aa, Artificial Sequence
  Description of Artificial Sequence: Synthetic construct
EVQLVESGGGLVQPGGSLRLSCAASGFNIKDTCIGWVRRAPGKGTELVAEICQDIGYTRYADSVKGRFTISADTSKNTAYLQMNSLRAEDTAVYYCAADESVDNFKYWGQGTTVTVSS

SEQ ID NO: 80 - DNA, 354 bp, Artificial Sequence
  Description of Artificial Sequence: Synthetic construct
gaagttcagctggttgaaagcggtggtggtctggttcagcctggtggtagcctgcgtctgagctgtgcagcaagctcttttaatatcaaagatacctatattggttgggttcgtcgtgcaccgggtaaaggtacagaactggttgcagaaattgcttgccatgaaggtactacccgttatgcagatagcgtgaaaggtcgttttaccattagctgcgataccagcaaaaataccgcatatctgcagatgaatagcctgcgtgccgaggacacggccgtatattactgtgcgaacactgaatacgacgacatcttcgactactgggggcaaggaaccaccgtcaccgtctcgagt

SEQ ID NO: 81 - protein, 118 aa, Artificial Sequence
  Description of Artificial Sequence: Synthetic construct
EVQLVESGGGLVQPGGSLRLSCAASSFNIKDTYIGWVRRAPGKGTELVAEIACHEGTTRYADSVKGRFTISCDTSKNTAYLQMNSLRAEDTAVYYCANTEYDDIFDYWGQGTTVTVSS

SEQ ID NO: 82 - DNA, 354 bp, Artificial Sequence
  Description of Artificial Sequence: Synthetic construct
gaagttcagctggttgaaagcggtggtggtctggttcagcctggtggtagcctgcgtctgagctgtgcagcaagcggttttaatatcaaagatacctgtattggttgggttcgtcgtgcaccgggtaaaggtacagaactggttgcagaaatttgtgaagacatcggttacacccgttatgcagatagcgtgaaaggtcgttttaccattagcgcagataccagcaaaaataccgcatatctgcagatgaatagcctgcgtgccgaggacacggccgtatattactgtgcggctaacgaacattctgttggtttcaactactgggggcaaggaaccaccgtcaccgtctcgagt

SEQ ID NO: 83 - protein, 118 aa, Artificial Sequence
  Description of Artificial Sequence: Synthetic construct
EVQLVESGGGLVQPGGSLRLSCAASGFNIKDTCIGWVRRAPGKGTELVAEICEDIGYTRYADSVKGRFTISADTSKNTAYLQMNSLRAEDTAVYYCAANEHSVGFNYWGQGTTVTVSS

SEQ ID NO: 84 - DNA, 354 bp, Artificial Sequence
  Description of Artificial Sequence: Synthetic construct
gaagttcagctggttgaaagcggtggtggtctggttcagcctggtggtagcctgcgtctgagctgtgcagcaagcggttttaatatcaaagatacctgtattggttgggttcgtcgtgcaccgggtaaaggtacagaactggttgcagaaatttgtcaggacatcggttacacccgttatgcagatagcgtgaaaggtcgttttaccattagcgcagataccagcaaaaataccgcatatctgcagatgaatagcctgcgtgccgaggacacggccgtatattactgtgcgggtgaagaaggtgctactaacttcaaatactgggggcaaggaaccaccgtcaccgtctcgagt

SEQ ID NO: 85 - protein, 118 aa, Artificial Sequence
  Description of Artificial Sequence: Synthetic construct
EVQLVESGGGLVQPGGSLRLSCAASGFNIKDTCIGWVRRAPGKGTELVAEICQDIGYTRYADSVKGRFTISADTSKNTAYLQMNSLRAEDTAVYYCAGEEGATNFKYWGQGTTVTVSS

SEQ ID NO: 86 - DNA, 354 bp, Artificial Sequence
  Description of Artificial Sequence: Synthetic construct
gaagttcagctggttgaaagcggtggtggtctggttcagcctggtggtagcctgcgtctgagctgtgcagcaagcggttttagcatcaaagatacctgtattgcatgggttcgtcgtgcaccgggtaaaggtacagaactggttgcagaaatttgtgaagacatcggttacacccgttatgcagatagcgtgaaaggtcgttttaccattagcgcagataccagcaaaaataccgcatatctgcagatgaatagcctgcgtgccgaggacacggccgtatattactgtgcggctaaagaagctggtgttggtttcgactactgggggcaaggaaccaccgtcaccgtctcgagt

SEQ ID NO: 87 - protein, 118 aa, Artificial Sequence
  Description of Artificial Sequence: Synthetic construct
EVQLVESGGGLVQPGGSLRLSCAASGFSIKDTCIAWVRRAPGKGTELVAEICEDIGYTRYADSVKGRFTISADTSKNTAYLQMNSLRAEDTAVYYCAAKEAGVGFDYWGQGTTVTVSS

SEQ ID NO: 88 - DNA, 354 bp, Artificial Sequence
  Description of Artificial Sequence: Synthetic construct
gaagttcagctggttgaaagcggtggtggtctggttcagcctggtggtagcctgcgtctgagctgtgcagcaagcggttttaatatcaaagatacctgtattggttgggttcgtcgtgcaccgggtaaaggtacagaactggttgcagaaatttgtactgacgctggttacacccgttatgcagatagcgtgaaaggtcgttttaccattagcgcagataccagcaaaaataccgcatatctgcagatgaatagcctgcgtgccgaggacacggccgtatattactgtgcggcttctgaatctccgtctggtttccgttactgggggcaaggaaccaccgtcaccgtctcgagt

SEQ ID NO: 89 - protein, 118 aa, Artificial Sequence
  Description of Artificial Sequence: Synthetic construct
EVQLVESGGGLVQPGGSLRLSCAASGFNIKDTCIGWVRRAPGKGTELVAEICTDAGYTRYADSVKGRFTISADTSKNTAYLQMNSLRAEDTAVYYCAASESPSGFRYWGQGTTVTVSS

SEQ ID NO: 90 - DNA, 354 bp, Artificial Sequence
  Description of Artificial Sequence: Synthetic construct
gaagttcagctggttgaaagcggtggtggtctggttcagcctggtggtagcctgcgtctgagctgtgcagcaagcggttttaatatcaaagatacctgtattggttgggttcgtcgtgcaccgggtaaaggtacagaactggttgcagaaatttgtcatgacatcggttacacccgttatgcagatagcgtgaaaggtcgttttaccattagcgcagataccagcaaaaataccgcatatctgcagatgaatagcctgcgtgccgaggacacggccgtatattactgtgcggctgaagaacatgttgcttctttcgaatactgggggcaaggaaccaccgtcaccgtctcgagt

SEQ ID NO: 91 - protein, 118 aa, Artificial Sequence
  Description of Artificial Sequence: Synthetic construct
EVQLVESGGGLVQPGGSLRLSCAASGFNIKDTCIGWVRRAPGKGTELVAEICHDIGYTRYADSVKGRFTISADTSKNTAYLQMNSLRAEDTAVYYCAAEEHVASFEYWGQGTTVTVSS

SEQ ID NO: 92 - DNA, 354 bp, Artificial Sequence
  Description of Artificial Sequence: Synthetic construct
gaagttcagctggttgaaagcggtggtggtctggttcagcctggtggtagcctgcgtctgagctgtgcagcaagcggttttaatatcaaagatacctgtattggttgggttcgtcgtgcaccgggtaaaggtacagaactggttgcagaaatttgtcaggacatcggttacacccgttatgcagatagcgtgaaaggtcgttttaccattagcgcagataccagcaaaaataccgcatatctgcagatgaatagcctgcgtgccgaggacacggccgtatattactgtgcggctgttgaagttgctgaatacttcgaatactgggggcaaggaaccaccgtcaccgtctcgagt

SEQ ID NO: 93 - protein, 118 aa, Artificial Sequence
  Description of Artificial Sequence: Synthetic construct
EVQLVESGGGLVQPGGSLRLSCAASGFNIKDTCIGWVRRAPGKGTELVAEICQDIGYTRYADSVKGRFTISADTSKNTAYLQMNSLRAEDTAVYYCAAVEVAEYFEYWGQGTTVTVSS

SEQ ID NO: 94 - DNA, 354 bp, Artificial Sequence
  Description of Artificial Sequence: Synthetic construct
gaagttcagctggttgaaagcggtggtggtctggttcagcctggtggtagcctgcgtctgagctgtgcagcaagcggttttaacatcaaatatcagtgtattggctgggttcgtcgtgcaccgggtaaaggtacagaactggttgcagaaatttgttcttacgacggttacacccgttatgcagatagcgtgaaaggtcgttttaccattagcgcagataccagcaaaaataccgcatatctgcagatgaatagcctgcgtgccgaggacacggccgtatattactgtgcggctgaagaatctgttgaaggtttcatctactgggggcaaggaaccaccgtcaccgtctcgagt

SEQ ID NO: 95 - protein, 118 aa, Artificial Sequence
  Description of Artificial Sequence: Synthetic construct
EVQLVESGGGLVQPGGSLRLSCAASGFNIKYQCIGWVRRAPGKGTELVAEICSYDGYTRYADSVKGRFTISADTSKNTAYLQMNSLRAEDTAVYYCAAEESVEGFIYWGQGTTVTVSS

SEQ ID NO: 96 - DNA, 354 bp, Artificial Sequence
  Description of Artificial Sequence: Synthetic construct
gaagttcagctggttgaaagcggtggtggtctggttcagcctggtggtagcctgcgtctgagctgtgcagcaagcggttttaatatcaaagatacctgtattggttgggttcgtcgtgcaccgggtaaaggtacagaactggttgcagaaatttgtgacgacatcggttacacccgttatgcagatagcgtgaaaggtcgttttaccattagcgcagataccagcaaaaataccgcatatctgcagatgaatagcctgcgtgccgaggacacggccgtatattactgtgcgtctcaggaacatcagtggtctttcaaatactgggggcaaggaaccaccgtcaccgtctcgagt

SEQ ID NO: 97 - protein, 118 aa, Artificial Sequence
  Description of Artificial Sequence: Synthetic construct
EVQLVESGGGLVQPGGSLRLSCAASGFNIKDTCIGWVRRAPGKGTELVAEICDDIGYTRYADSVKGRFTISADTSKNTAYLQMNSLRAEDTAVYYCASQEHQWSFKYWGQGTTVTVSS

SEQ ID NO: 98 - DNA, 1065 bp, Artificial Sequence
  Description of Artificial Sequence: Synthetic construct
gaagttcagctggttgaaagcggtggtggtctggttcagcctggtggtagcctgcgtctgagctgtgcagcaagcggttttaatatcaaagatacctgtattggttgggttcgtcgtgcaccgggtaaaggtacagaactggttgcagaaatttgtactgacatcggttacacccgttatgcagatagcgtgaaaggtcgttttaccattagcgcagataccagcaaaaataccgcatatctgcagatgaatagcctgcgtgccgaggacacggccgtatattactgtgcggctggtgaaggttcttctggtttccattactgggggcaaggaaccaccgtcaccgtctcgagtggaggaggcggaagtggaggcggaggatccgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 99 - protein, 355 aa, Artificial Sequence
  Description of Artificial Sequence: Synthetic construct
EVQLVESGGGLVQPGGSLRLSCAASGFNIKDTCIGWVRRAPGKGTELVAEICTDIGYTRYADSVKGRFTISADTSKNTAYLQMNSLRAEDTAVYYCAAGEGSSGFHYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 100 - DNA, 1065 bp, Artificial Sequence
  Description of Artificial Sequence: Synthetic construct
gaagttcagctggttgaaagcggtggtggtctggttcagcctggtggtagcctgcgtctgagctgtgcagcaagcggttttaatatcaaagatacctgtattggttgggttcgtcgtgcaccgggtaaaggtacagaactggttgcagaaatttgtcaggacatcggttacacccgttatgcagatagcgtgaaaggtcgttttaccattagcgcagataccagcaaaaataccgcatatctgcagatgaatagcctgcgtgccgaggacacggccgtatattactgtgcggctgacgaatctgttgacaacttcaaatactgggggcaaggaaccaccgtcaccgtctcgagtggaggaggcggaagtggaggcggaggatccgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 101 - protein, 355 aa, Artificial Sequence
  Description of Artificial Sequence: Synthetic construct
EVQLVESGGGLVQPGGSLRLSCAASGFNIKDTCIGWVRRAPGKGTELVAEICQDIGYTRYADSVKGRFTISADTSKNTAYLQMNSLRAEDTAVYYCAADESVDNFKYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 102 - DNA, 1065 bp, Artificial Sequence
  Description of Artificial Sequence: Synthetic construct
gaagttcagctggttgaaagcggtggtggtctggttcagcctggtggtagcctgcgtctgagctgtgcagcaagctcttttaatatcaaagatacctatattggttgggttcgtcgtgcaccgggtaaaggtacagaactggttgcagaaattgcttgccatgaaggtactacccgttatgcagatagcgtgaaaggtcgttttaccattagctgcgataccagcaaaaataccgcatatctgcagatgaatagcctgcgtgccgaggacacggccgtatattactgtgcgaacactgaatacgacgacatcttcgactactgggggcaaggaaccaccgtcaccgtctcgagtggaggaggcggaagtggaggcggaggatccgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 103 - protein, 355 aa, Artificial Sequence
  Description of Artificial Sequence: Synthetic construct
EVQLVESGGGLVQPGGSLRLSCAASSFNIKDTYIGWVRRAPGKGTELVAEIACHEGTTRYADSVKGRFTISCDTSKNTAYLQMNSLRAEDTAVYYCANTEYDDIFDYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 104 - DNA, 1065 bp, Artificial Sequence
  Description of Artificial Sequence: Synthetic construct
gaagttcagctggttgaaagcggtggtggtctggttcagcctggtggtagcctgcgtctgagctgtgcagcaagcggttttaatatcaaagatacctgtattggttgggttcgtcgtgcaccgggtaaaggtacagaactggttgcagaaatttgtgaagacatcggttacacccgttatgcagatagcgtgaaaggtcgttttaccattagcgcagataccagcaaaaataccgcatatctgcagatgaatagcctgcgtgccgaggacacggccgtatattactgtgcggctaacgaacattctgttggtttcaactactgggggcaaggaaccaccgtcaccgtctcgagtggaggaggcggaagtggaggcggaggatccgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 105 - protein, 355 aa, Artificial Sequence
  Description of Artificial Sequence: Synthetic construct
EVQLVESGGGLVQPGGSLRLSCAASGFNIKDTCIGWVRRAPGKGTELVAEICEDIGYTRYADSVKGRFTISADTSKNTAYLQMNSLRAEDTAVYYCAANEHSVGFNYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 106 - DNA, 1065 bp, Artificial Sequence
  Description of Artificial Sequence: Synthetic construct
gaagttcagctggttgaaagcggtggtggtctggttcagcctggtggtagcctgcgtctgagctgtgcagcaagcggttttaatatcaaagatacctgtattggttgggttcgtcgtgcaccgggtaaaggtacagaactggttgcagaaatttgtcaggacatcggttacacccgttatgcagatagcgtgaaaggtcgttttaccattagcgcagataccagcaaaaataccgcatatctgcagatgaatagcctgcgtgccgaggacacggccgtatattactgtgcgggtgaagaaggtgctactaacttcaaatactgggggcaaggaaccaccgtcaccgtctcgagtggaggaggcggaagtggaggcggaggatccgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 107 - protein, 355 aa, Artificial Sequence
  Description of Artificial Sequence: Synthetic construct
EVQLVESGGGLVQPGGSLRLSCAASGFNIKDTCIGWVRRAPGKGTELVAEICQDIGYTRYADSVKGRFTISADTSKNTAYLQMNSLRAEDTAVYYCAGEEGATNFKYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 108 - DNA, 1065 bp, Artificial Sequence
  Description of Artificial Sequence: Synthetic construct
gaagttcagctggttgaaagcggtggtggtctggttcagcctggtggtagcctgcgtctgagctgtgcagcaagcggttttagcatcaaagatacctgtattgcatgggttcgtcgtgcaccgggtaaaggtacagaactggttgcagaaatttgtgaagacatcggttacacccgttatgcagatagcgtgaaaggtcgttttaccattagcgcagataccagcaaaaataccgcatatctgcagatgaatagcctgcgtgccgaggacacggccgtatattactgtgcggctaaagaagctggtgttggtttcgactactgggggcaaggaaccaccgtcaccgtctcgagtggaggaggcggaagtggaggcggaggatccgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 109 - protein, 355 aa, Artificial Sequence
  Description of Artificial Sequence: Synthetic construct
EVQLVESGGGLVQPGGSLRLSCAASGFSIKDTCIAWVRRAPGKGTELVAEICEDIGYTRYADSVKGRFTISADTSKNTAYLQMNSLRAEDTAVYYCAAKEAGVGFDYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 110 - DNA, 1065 bp, Artificial Sequence
  Description of Artificial Sequence: Synthetic construct
gaagttcagctggttgaaagcggtggtggtctggttcagcctggtggtagcctgcgtctgagctgtgcagcaagcggttttaatatcaaagatacctgtattggttgggttcgtcgtgcaccgggtaaaggtacagaactggttgcagaaatttgtactgacgctggttacacccgttatgcagatagcgtgaaaggtcgttttaccattagcgcagataccagcaaaaataccgcatatctgcagatgaatagcctgcgtgccgaggacacggccgtatattactgtgcggcttctgaatctccgtctggtttccgttactgggggcaaggaaccaccgtcaccgtctcgagtggaggaggcggaagtggaggcggaggatccgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 111 - protein, 355 aa, Artificial Sequence
  Description of Artificial Sequence: Synthetic construct
EVQLVESGGGLVQPGGSLRLSCAASGFNIKDTCIGWVRRAPGKGTELVAEICTDAGYTRYADSVKGRFTISADTSKNTAYLQMNSLRAEDTAVYYCAASESPSGFRYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 112 - DNA, 1065 bp, Artificial Sequence
  Description of Artificial Sequence: Synthetic construct
gaagttcagctggttgaaagcggtggtggtctggttcagcctggtggtagcctgcgtctgagctgtgcagcaagcggttttaatatcaaagatacctgtattggttgggttcgtcgtgcaccgggtaaaggtacagaactggttgcagaaatttgtcatgacatcggttacacccgttatgcagatagcgtgaaaggtcgttttaccattagcgcagataccagcaaaaataccgcatatctgcagatgaatagcctgcgtgccgaggacacggccgtatattactgtgcggctgaagaacatgttgcttctttcgaatactgggggcaaggaaccaccgtcaccgtctcgagtggaggaggcggaagtggaggcggaggatccgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 113 - protein, 355 aa, Artificial Sequence
  Description of Artificial Sequence: Synthetic construct
EVQLVESGGGLVQPGGSLRLSCAASGFNIKDTCIGWVRRAPGKGTELVAEICHDIGYTRYADSVKGRFTISADTSKNTAYLQMNSLRAEDTAVYYCAAEEHVASFEYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 114 - DNA, 1065 bp, Artificial Sequence
  Description of Artificial Sequence: Synthetic construct
gaagttcagctggttgaaagcggtggtggtctggttcagcctggtggtagcctgcgtctgagctgtgcagcaagcggttttaatatcaaagatacctgtattggttgggttcgtcgtgcaccgggtaaaggtacagaactggttgcagaaatttgtcaggacatcggttacacccgttatgcagatagcgtgaaaggtcgttttaccattagcgcagataccagcaaaaataccgcatatctgcagatgaatagcctgcgtgccgaggacacggccgtatattactgtgcggctgttgaagttgctgaatacttcgaatactgggggcaaggaaccaccgtcaccgtctcgagtggaggaggcggaagtggaggcggaggatccgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 115 - protein, 355 aa, Artificial Sequence
  Description of Artificial Sequence: Synthetic construct
EVQLVESGGGLVQPGGSLRLSCAASGFNIKDTCIGWVRRAPGKGTELVAEICQDIGYTRYADSVKGRFTISADTSKNTAYLQMNSLRAEDTAVYYCAAVEVAEYFEYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 116 - DNA, 1065 bp, Artificial Sequence
  Description of Artificial Sequence: Synthetic construct
gaagttcagctggttgaaagcggtggtggtctggttcagcctggtggtagcctgcgtctgagctgtgcagcaagcggttttaacatcaaatatcagtgtattggctgggttcgtcgtgcaccgggtaaaggtacagaactggttgcagaaatttgttcttacgacggttacacccgttatgcagatagcgtgaaaggtcgttttaccattagcgcagataccagcaaaaataccgcatatctgcagatgaatagcctgcgtgccgaggacacggccgtatattactgtgcggctgaagaatctgttgaaggtttcatctactgggggcaaggaaccaccgtcaccgtctcgagtggaggaggcggaagtggaggcggaggatccgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 117 - protein, 355 aa, Artificial Sequence
  Description of Artificial Sequence: Synthetic construct
EVQLVESGGGLVQPGGSLRLSCAASGFNIKYQCIGWVRRAPGKGTELVAEICSYDGYTRYADSVKGRFTISADTSKNTAYLQMNSLRAEDTAVYYCAAEESVEGFIYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 118 - DNA, 1065 bp, Artificial Sequence
  Description of Artificial Sequence: Synthetic construct
gaagttcagctggttgaaagcggtggtggtctggttcagcctggtggtagcctgcgtctgagctgtgcagcaagcggttttaatatcaaagatacctgtattggttgggttcgtcgtgcaccgggtaaaggtacagaactggttgcagaaatttgtgacgacatcggttacacccgttatgcagatagcgtgaaaggtcgttttaccattagcgcagataccagcaaaaataccgcatatctgcagatgaatagcctgcgtgccgaggacacggccgtatattactgtgcgtctcaggaacatcagtggtctttcaaatactgggggcaaggaaccaccgtcaccgtctcgagtggaggaggcggaagtggaggcggaggatccgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 119 - protein, 355 aa, Artificial Sequence
  Description of Artificial Sequence: Synthetic construct
EVQLVESGGGLVQPGGSLRLSCAASGFNIKDTCIGWVRRAPGKGTELVAEICDDIGYTRYADSVKGRFTISADTSKNTAYLQMNSLRAEDTAVYYCASQEHQWSFKYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 120 - DNA, 1065 bp, Artificial Sequence
  Description of Artificial Sequence: Synthetic construct
gaagttcagctggttgaaagcggtggtggtctggttcagcctggtggtagcctgcgtctgagctgtgcagcaagcggttttaatatcaaagatacctgtattggttgggttcgtcgtgcaccgggtaaaggtacagaactggttgcagaaatttgtactgacatcggttacacccgttatgcagatagcgtgaaaggtcgttttaccattagcgcagataccagcaaaaataccgcatatctgcagatgaatagcctgcgtgccgaggacacggccgtatattactgtgcggctggtgaaggttcttctggtttccattactgggggcaaggaaccaccgtcaccgtctcgagtggaggaggcggaagtggaggcggaggatccgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 121 - protein, 355 aa, Artificial Sequence
  Description of Artificial Sequence: Synthetic construct
EVQLVESGGGLVQPGGSLRLSCAASGFNIKDTCIGWVRRAPGKGTELVAEICTDIGYTRYADSVKGRFTISADTSKNTAYLQMNSLRAEDTAVYYCAAGEGSSGFHYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 122 - DNA, 1065 bp, Artificial Sequence
  Description of Artificial Sequence: Synthetic construct
gaagttcagctggttgaaagcggtggtggtctggttcagcctggtggtagcctgcgtctgagctgtgcagcaagcggttttaatatcaaagatacctgtattggttgggttcgtcgtgcaccgggtaaaggtacagaactggttgcagaaatttgtcaggacatcggttacacccgttatgcagatagcgtgaaaggtcgttttaccattagcgcagataccagcaaaaataccgcatatctgcagatgaatagcctgcgtgccgaggacacggccgtatattactgtgcggctgacgaatctgttgacaacttcaaatactgggggcaaggaaccaccgtcaccgtctcgagtggaggaggcggaagtggaggcggaggatccgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 123 - protein, 355 aa, Artificial Sequence
  Description of Artificial Sequence: Synthetic construct
EVQLVESGGGLVQPGGSLRLSCAASGFNIKDTCIGWVRRAPGKGTELVAEICQDIGYTRYADSVKGRFTISADTSKNTAYLQMNSLRAEDTAVYYCAADESVDNFKYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 124 - DNA, 1065 bp, Artificial Sequence
  Description of Artificial Sequence: Synthetic construct
gaagttcagctggttgaaagcggtggtggtctggttcagcctggtggtagcctgcgtctgagctgtgcagcaagctcttttaatatcaaagatacctatattggttgggttcgtcgtgcaccgggtaaaggtacagaactggttgcagaaattgcttgccatgaaggtactacccgttatgcagatagcgtgaaaggtcgttttaccattagctgcgataccagcaaaaataccgcatatctgcagatgaatagcctgcgtgccgaggacacggccgtatattactgtgcgaacactgaatacgacgacatcttcgactactgggggcaaggaaccaccgtcaccgtctcgagtggaggaggcggaagtggaggcggaggatccgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 125 - protein, 355 aa, Artificial Sequence
  Description of Artificial Sequence: Synthetic construct
EVQLVESGGGLVQPGGSLRLSCAASSFNIKDTYIGWVRRAPGKGTELVAEIACHEGTTRYADSVKGRFTISCDTSKNTAYLQMNSLRAEDTAVYYCANTEYDDIFDYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 126 - DNA, 1065 bp, Artificial Sequence
  Description of Artificial Sequence: Synthetic construct
gaagttcagctggttgaaagcggtggtggtctggttcagcctggtggtagcctgcgtctgagctgtgcagcaagcggttttaatatcaaagatacctgtattggttgggttcgtcgtgcaccgggtaaaggtacagaactggttgcagaaatttgtgaagacatcggttacacccgttatgcagatagcgtgaaaggtcgttttaccattagcgcagataccagcaaaaataccgcatatctgcagatgaatagcctgcgtgccgaggacacggccgtatattactgtgcggctaacgaacattctgttggtttcaactactgggggcaaggaaccaccgtcaccgtctcgagtggaggaggcggaagtggaggcggaggatccgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 127 - protein, 355 aa, Artificial Sequence
  Description of Artificial Sequence: Synthetic construct
EVQLVESGGGLVQPGGSLRLSCAASGFNIKDTCIGWVRRAPGKGTELVAEICEDIGYTRYADSVKGRFTISADTSKNTAYLQMNSLRAEDTAVYYCAANEHSVGFNYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 128 - DNA, 1065 bp, Artificial Sequence
  Description of Artificial Sequence: Synthetic construct
gaagttcagctggttgaaagcggtggtggtctggttcagcctggtggtagcctgcgtctgagctgtgcagcaagcggttttaatatcaaagatacctgtattggttgggttcgtcgtgcaccgggtaaaggtacagaactggttgcagaaatttgtcaggacatcggttacacccgttatgcagatagcgtgaaaggtcgttttaccattagcgcagataccagcaaaaataccgcatatctgcagatgaatagcctgcgtgccgaggacacggccgtatattactgtgcgggtgaagaaggtgctactaacttcaaatactgggggcaaggaaccaccgtcaccgtctcgagtggaggaggcggaagtggaggcggaggatccgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 129 - protein, 355 aa, Artificial Sequence
  Description of Artificial Sequence: Synthetic construct
EVQLVESGGGLVQPGGSLRLSCAASGFNIKDTCIGWVRRAPGKGTELVAEICQDIGYTRYADSVKGRFTISADTSKNTAYLQMNSLRAEDTAVYYCAGEEGATNFKYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 130 - DNA, 1065 bp, Artificial Sequence
  Description of Artificial Sequence: Synthetic construct
gaagttcagctggttgaaagcggtggtggtctggttcagcctggtggtagcctgcgtctgagctgtgcagcaagcggttttagcatcaaagatacctgtattgcatgggttcgtcgtgcaccgggtaaaggtacagaactggttgcagaaatttgtgaagacatcggttacacccgttatgcagatagcgtgaaaggtcgttttaccattagcgcagataccagcaaaaataccgcatatctgcagatgaatagcctgcgtgccgaggacacggccgtatattactgtgcggctaaagaagctggtgttggtttcgactactgggggcaaggaaccaccgtcaccgtctcgagtggaggaggcggaagtggaggcggaggatccgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 131 - protein, 355 aa, Artificial Sequence
  Description of Artificial Sequence: Synthetic construct
EVQLVESGGGLVQPGGSLRLSCAASGFSIKDTCIAWVRRAPGKGTELVAEICEDIGYTRYADSVKGRFTISADTSKNTAYLQMNSLRAEDTAVYYCAAKEAGVGFDYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 132 - DNA, 1065 bp, Artificial Sequence
  Description of Artificial Sequence: Synthetic construct
gaagttcagctggttgaaagcggtggtggtctggttcagcctggtggtagcctgcgtctgagctgtgcagcaagcggttttaatatcaaagatacctgtattggttgggttcgtcgtgcaccgggtaaaggtacagaactggttgcagaaatttgtactgacgctggttacacccgttatgcagatagcgtgaaaggtcgttttaccattagcgcagataccagcaaaaataccgcatatctgcagatgaatagcctgcgtgccgaggacacggccgtatattactgtgcggcttctgaatctccgtctggtttccgttactgggggcaaggaaccaccgtcaccgtctcgagtggaggaggcggaagtggaggcggaggatccgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 133 - protein, 355 aa, Artificial Sequence
  Description of Artificial Sequence: Synthetic construct
EVQLVESGGGLVQPGGSLRLSCAASGFNIKDTCIGWVRRAPGKGTELVAEICTDAGYTRYADSVKGRFTISADTSKNTAYLQMNSLRAEDTAVYYCAASESPSGFRYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 134 - DNA, 1065 bp, Artificial Sequence
  Description of Artificial Sequence: Synthetic construct
gaagttcagctggttgaaagcggtggtggtctggttcagcctggtggtagcctgcgtctgagctgtgcagcaagcggttttaatatcaaagatacctgtattggttgggttcgtcgtgcaccgggtaaaggtacagaactggttgcagaaatttgtcatgacatcggttacacccgttatgcagatagcgtgaaaggtcgttttaccattagcgcagataccagcaaaaataccgcatatctgcagatgaatagcctgcgtgccgaggacacggccgtatattactgtgcggctgaagaacatgttgcttctttcgaatactgggggcaaggaaccaccgtcaccgtctcgagtggaggaggcggaagtggaggcggaggatccgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 135 - protein, 355 aa, Artificial Sequence
  Description of Artificial Sequence: Synthetic construct
EVQLVESGGGLVQPGGSLRLSCAASGFNIKDTCIGWVRRAPGKGTELVAEICHDIGYTRYADSVKGRFTISADTSKNTAYLQMNSLRAEDTAVYYCAAEEHVASFEYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 136 - DNA, 1065 bp, Artificial Sequence
  Description of Artificial Sequence: Synthetic construct
gaagttcagctggttgaaagcggtggtggtctggttcagcctggtggtagcctgcgtctgagctgtgcagcaagcggttttaatatcaaagatacctgtattggttgggttcgtcgtgcaccgggtaaaggtacagaactggttgcagaaatttgtcaggacatcggttacacccgttatgcagatagcgtgaaaggtcgttttaccattagcgcagataccagcaaaaataccgcatatctgcagatgaatagcctgcgtgccgaggacacggccgtatattactgtgcggctgttgaagttgctgaatacttcgaatactgggggcaaggaaccaccgtcaccgtctcgagtggaggaggcggaagtggaggcggaggatccgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 137 - protein, 355 aa, Artificial Sequence
  Description of Artificial Sequence: Synthetic construct
EVQLVESGGGLVQPGGSLRLSCAASGFNIKDTCIGWVRRAPGKGTELVAEICQDIGYTRYADSVKGRFTISADTSKNTAYLQMNSLRAEDTAVYYCAAVEVAEYFEYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 138 - DNA, 1065 bp, Artificial Sequence
  Description of Artificial Sequence: Synthetic construct
gaagttcagctggttgaaagcggtggtggtctggttcagcctggtggtagcctgcgtctgagctgtgcagcaagcggttttaacatcaaatatcagtgtattggctgggttcgtcgtgcaccgggtaaaggtacagaactggttgcagaaatttgttcttacgacggttacacccgttatgcagatagcgtgaaaggtcgttttaccattagcgcagataccagcaaaaataccgcatatctgcagatgaatagcctgcgtgccgaggacacggccgtatattactgtgcggctgaagaatctgttgaaggtttcatctactgggggcaaggaaccaccgtcaccgtctcgagtggaggaggcggaagtggaggcggaggatccgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 139 - protein, 355 aa, Artificial Sequence
  Description of Artificial Sequence: Synthetic construct
EVQLVESGGGLVQPGGSLRLSCAASGFNIKYQCIGWVRRAPGKGTELVAEICSYDGYTRYADSVKGRFTISADTSKNTAYLQMNSLRAEDTAVYYCAAEESVEGFIYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 140 - DNA, 1065 bp, Artificial Sequence
  Description of Artificial Sequence: Synthetic construct
gaagttcagctggttgaaagcggtggtggtctggttcagcctggtggtagcctgcgtctgagctgtgcagcaagcggttttaatatcaaagatacctgtattggttgggttcgtcgtgcaccgggtaaaggtacagaactggttgcagaaatttgtgacgacatcggttacacccgttatgcagatagcgtgaaaggtcgttttaccattagcgcagataccagcaaaaataccgcatatctgcagatgaatagcctgcgtgccgaggacacggccgtatattactgtgcgtctcaggaacatcagtggtctttcaaatactgggggcaaggaaccaccgtcaccgtctcgagtggaggaggcggaagtggaggcggaggatccgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtacaccctgcccccatgccgggatgagctgaccaagaaccaggtcagcctgtggtgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 141 - protein, 355 aa, Artificial Sequence
  Description of Artificial Sequence: Synthetic construct
EVQLVESGGGLVQPGGSLRLSCAASGFNIKDTCIGWVRRAPGKGTELVAEICDDIGYTRYADSVKGRFTISADTSKNTAYLQMNSLRAEDTAVYYCASQEHQWSFKYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 142 - DNA, 1410 bp, Artificial Sequence
  Description of Artificial Sequence: Synthetic construct
atgggatggagctgtatcatcctcttcttggtagcaacagctacaggtgtgcattccgaagtgcagctgctcgaaagcggcgggggactggtccagcccggcggttccctgaggctgtcttgcgccgcttcagggttcagcttttcctcttacaccatgagttgggtcagacaggcacctggcaagggactggagtgggtcgccacaatcagcggtggcgggcgcgacatttattacccagattccgtgaaaggacggttcaccatctctagggacaactcaaagaatactctgtatttgcagatgaacagcctgagagctgaggatacagcagtttactactgtgtgctcctgaccggccgcgtctattttgcccttgactcctggggacaaggcactctggtgaccgtatctagtgctagcaccaagggcccctccgtgttccccctggcccccagcagcaagagcaccagcggcggcacagccgctctgggctgcctggtcaaggactacttccccgagcccgtgaccgtgtcctggaacagcggagccctgacctccggcgtgcacaccttccccgccgtgctgcagagttctggcctgtatagcctgagcagcgtggtcaccgtgccttctagcagcctgggcacccagacctacatctgcaacgtgaaccacaagcccagcaacaccaaggtggacaagaaggtggagcccaagagctgcgacaaaactcacacatgcccaccgtgcccagcacctgaagctgcagggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcggcgcccccatcgagaaaaccatctccaaagccaaagggcagccccgagaaccacaggtgtgcaccctgcccccatcccgggatgagctgaccaagaaccaggtcagcctctcgtgcgcagtcaaaggcttctatcccagcgacatcgccgtggagtgggagagcaatgggcagccggagaacaactacaagaccacgcctcccgtgctggactccgacggctccttcttcctcgtgagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 143 - protein, 469 aa, Artificial Sequence
  Description of Artificial Sequence: Synthetic construct
MGWSCIILFLVATATGVHSEVQLLESGGGLVQPGGSLRLSCAASGFSFSSYTMSWVRQAPGKGLEWVATISGGGRDIYYPDSVKGRFTISRDNSKNTLYLQMNSLRAEDTAVYYCVLLTGRVYFALDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 144 - DNA, 714 bp, Artificial Sequence
  Description of Artificial Sequence: Synthetic construct
atgggatggagctgtatcatcctcttcttggtagcaacagctacaggtgtgcattccgacatcgtgatgacccagagccccgattccctggccgtctctctcggcgagagggctacaattaactgcaaggcatcagaaagcgtggacacctccgataattctttcatccactggtatcagcagaaacctgggcagagtccaaagctgcttatttatagaagctccactctggagtctggagtccccgaccgctttagcggcagcggttccgggacagacttcaccctcactatctctagtctgcaagccgaggatgtggctgtttactattgtcagcagaactacgacgtgccttggacctttggccagggaacaaaggtcgaaataaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 145 - protein, 237 aa, Artificial Sequence
  Description of Artificial Sequence: Synthetic construct
MGWSCIILFLVATATGVHSDIVMTQSPDSLAVSLGERATINCKASESVDTSDNSFIHWYQQKPGQSPKLLIYRSSTLESGVPDRFSGSGSGTDFTLTISSLQAEDVAVYYCQQNYDVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 146 - protein, 5 aa, Artificial Sequence
  Description of Artificial Sequence: Synthetic construct
DTCIG

SEQ ID NO: 147 - protein, 17 aa, Artificial Sequence
  Description of Artificial Sequence: Synthetic construct
EICTDIGYTRYADSVKG

SEQ ID NO: 148 - protein, 9 aa, Artificial Sequence
  Description of Artificial Sequence: Synthetic construct
GEGSSGFHY

SEQ ID NO: 149 - protein, 5 aa, Artificial Sequence
  Description of Artificial Sequence: Synthetic construct
DTCIG

SEQ ID NO: 150 - protein, 17 aa, Artificial Sequence
  Description of Artificial Sequence: Synthetic construct
EICQDIGYTRYADSVKG

SEQ ID NO: 151 - protein, 9 aa, Artificial Sequence
  Description of Artificial Sequence: Synthetic construct
DESVDNFKY

SEQ ID NO: 152 - protein, 5 aa, Artificial Sequence
  Description of Artificial Sequence: Synthetic construct
DTYIG

SEQ ID NO: 153 - protein, 17 aa, Artificial Sequence
  Description of Artificial Sequence: Synthetic construct
EIACHEGTTRYADSVKG

SEQ ID NO: 154 - protein, 9 aa, Artificial Sequence
  Description of Artificial Sequence: Synthetic construct
TEYDDIFDY

SEQ ID NO: 155 - protein, 5 aa, Artificial Sequence
  Description of Artificial Sequence: Synthetic construct
DTCIG

SEQ ID NO: 156 - protein, 17 aa, Artificial Sequence
  Description of Artificial Sequence: Synthetic construct
EICEDIGYTRYADSVKG

SEQ ID NO: 157 - protein, 9 aa, Artificial Sequence
  Description of Artificial Sequence: Synthetic construct
NEHSVGFNY

SEQ ID NO: 158 - protein, 5 aa, Artificial Sequence
  Description of Artificial Sequence: Synthetic construct
DTCIG

SEQ ID NO: 159 - protein, 17 aa, Artificial Sequence
  Description of Artificial Sequence: Synthetic construct
EICQDIGYTRYADSVKG

SEQ ID NO: 160 - protein, 9 aa, Artificial Sequence
  Description of Artificial Sequence: Synthetic construct
EEGATNFKY

SEQ ID NO: 161 - protein, 5 aa, Artificial Sequence
  Description of Artificial Sequence: Synthetic construct
DTCIA

SEQ ID NO: 162 - protein, 17 aa, Artificial Sequence
  Description of Artificial Sequence: Synthetic construct
EICEDIGYTRYADSVKG

SEQ ID NO: 163 - protein, 9 aa, Artificial Sequence
  Description of Artificial Sequence: Synthetic construct
KEAGVGFDY

SEQ ID NO: 164 - protein, 5 aa, Artificial Sequence
  Description of Artificial Sequence: Synthetic construct
DTCIG

SEQ ID NO: 165 - protein, 17 aa, Artificial Sequence
  Description of Artificial Sequence: Synthetic construct
EICTDAGYTRYADSVKG

SEQ ID NO: 166 - protein, 9 aa, Artificial Sequence
  Description of Artificial Sequence: Synthetic construct
SESPSGFRY

SEQ ID NO: 167 - protein, 5 aa, Artificial Sequence
  Description of Artificial Sequence: Synthetic construct
DTCIG

SEQ ID NO: 168 - protein, 17 aa, Artificial Sequence
  Description of Artificial Sequence: Synthetic construct
EICHDIGYTRYADSVKG

SEQ ID NO: 169 - protein, 9 aa, Artificial Sequence
  Description of Artificial Sequence: Synthetic construct
EEHVASFEY

SEQ ID NO: 170 - protein, 5 aa, Artificial Sequence
  Description of Artificial Sequence: Synthetic construct
DTCIG

SEQ ID NO: 171 - protein, 17 aa, Artificial Sequence
  Description of Artificial Sequence: Synthetic construct
EICQDIGYTRYADSVKG

SEQ ID NO: 172 - protein, 9 aa, Artificial Sequence
  Description of Artificial Sequence: Synthetic construct
VEVAEYFEY

SEQ ID NO: 173 - protein, 5 aa, Artificial Sequence
  Description of Artificial Sequence: Synthetic construct
YQCIG

SEQ ID NO: 174 - protein, 17 aa, Artificial Sequence
  Description of Artificial Sequence: Synthetic construct
EICSYDGYTRYADSVKG

SEQ ID NO: 175 - protein, 9 aa, Artificial Sequence
  Description of Artificial Sequence: Synthetic construct
EESVEGFIY

SEQ ID NO: 176 - protein, 5 aa, Artificial Sequence
  Description of Artificial Sequence: Synthetic construct
DTCIG

SEQ ID NO: 177 - protein, 17 aa, Artificial Sequence
  Description of Artificial Sequence: Synthetic construct
EICDDIGYTRYADSVKG

SEQ ID NO: 178 - protein, 9 aa, Artificial Sequence
  Description of Artificial Sequence: Synthetic construct
QEHQWSFKY

SEQ ID NO: 179 - DNA, 348 bp, Artificial Sequence
  Description of Artificial Sequence: Synthetic construct
gaagttcagctggttgaaagcggtggtggtctggttcagcctggtggtagcctgcgtctgagctgtgcagcaagcggttttaatatcaaagatacctgtattggttgggttcgtcgtgcaccgggtaaaggtacagaactggttgcacgtatttgtccgaccaatggttatacccgttatgcagatagcgtgaaaggtcgttttaccattagcgcagataccagcaaaaataccgcatatctgcagatgaatagcctgcgtgccgaggacacggccgtatattactgtgcgagctacgttcgttacttcgactactgggggcaaggaaccaccgtcaccgtctcgagt

SEQ ID NO: 180 - protein, 116 aa, Artificial Sequence
  Description of Artificial Sequence: Synthetic construct
EVQLVESGGGLVQPGGSLRLSCAASGFNIKDTCIGWVRRAPGKGTELVARICPTNGYTRYADSVKGRFTISADTSKNTAYLQMNSLRAEDTAVYYCASYVRYFDYWGQGTTVTVSS

SEQ ID NO: 181 - protein, 118 aa, Artificial Sequence; identical to SEQ ID NO: 77
  Description of Artificial Sequence: Synthetic construct

SEQ ID NO: 182 - protein, 118 aa, Artificial Sequence; identical to SEQ ID NO: 79
  Description of Artificial Sequence: Synthetic construct

SEQ ID NO: 183 - protein, 118 aa, Artificial Sequence; identical to SEQ ID NO: 81
  Description of Artificial Sequence: Synthetic construct

SEQ ID NO: 184 - protein, 118 aa, Artificial Sequence; identical to SEQ ID NO: 83
  Description of Artificial Sequence: Synthetic construct

SEQ ID NO: 185 - protein, 118 aa, Artificial Sequence; identical to SEQ ID NO: 85
  Description of Artificial Sequence: Synthetic construct

SEQ ID NO: 186 - protein, 118 aa, Artificial Sequence; identical to SEQ ID NO: 87
  Description of Artificial Sequence: Synthetic construct

SEQ ID NO: 187 - protein, 118 aa, Artificial Sequence; identical to SEQ ID NO: 89
  Description of Artificial Sequence: Synthetic construct

SEQ ID NO: 188 - protein, 118 aa, Artificial Sequence; identical to SEQ ID NO: 91
  Description of Artificial Sequence: Synthetic construct

SEQ ID NO: 189 - protein, 118 aa, Artificial Sequence; identical to SEQ ID NO: 93
  Description of Artificial Sequence: Synthetic construct

SEQ ID NO: 190 - protein, 118 aa, Artificial Sequence; identical to SEQ ID NO: 95
  Description of Artificial Sequence: Synthetic construct

SEQ ID NO: 191 - protein, 118 aa, Artificial Sequence; identical to SEQ ID NO: 97
  Description of Artificial Sequence: Synthetic construct

SEQ ID NO: 192 - protein, 120 aa, Artificial Sequence
  Description of Artificial Sequence: Synthetic construct
EVQLLESGGGLVQPGGSLRLSCAASGFSFSSYTMSWVRQAPGKGLEWVATISGGGRDIYYPDSVKGRFTISRDNSKNTLYLQMNSLRAEDTAVYYCVLLTGRVYFALDSWGQGTLVTVSS

SEQ ID NO: 193 - protein, 111 aa, Artificial Sequence
  Description of Artificial Sequence: Synthetic construct
DIVMTQSPDSLAVSLGERATINCKASESVDTSDNSFIHWYQQKPGQSPKLLIYRSSTLESGVPDRFSGSGSGTDFTLTISSLQAEDVAVYYCQQNYDVPWTFGQGTKVEIK

SEQ ID NO: 194 - protein, 118 aa, Artificial Sequence
  Description of Artificial Sequence: Synthetic construct
EVQLVESGGGLVQPGGSLRLSCAASGFDIKRYCIGWVRRAPGKGTELVATICNTDGSTRYADSVKGRFTISADTSKNTAYLQMNSLRAEDTAVYYCAYEEWDQYFHYWGQGTTVTVSS

SEQ ID NO: 195 - protein, 119 aa, Artificial Sequence
  Description of Artificial Sequence: Synthetic construct
EVQLVESGGGLVQPGGSLRLSCAASGFNIKDSTYIGWVRRAPGKGTELVAYISCYDGDTRYADSVKGRFTISCDTSKNTAYLQMNSLRAEDTAVYYCAEYYYYHGFAYWGQGTTVTVSS

SEQ ID NO: 196 - protein, 117 aa, Artificial Sequence
  Description of Artificial Sequence: Synthetic construct
EVQLVESGGGLVQPGGSLRLSCAASGFNIKDYCIGWVRRAPGKGTELVASICPEGGYTRYADSVKGRFTISADTSKNTAYLQMNSLRAEDTAVYYCAYYGVYGFEYWGQGTTVTVSS

SEQ ID NO: 197 - protein, 118 aa, Artificial Sequence
  Description of Artificial Sequence: Synthetic construct
EVQLVESGGGLVQPGGSLRLSCAASSFNIKDTYIGWVRRAPGKGTELVAAISCSTGDTRYADSVKGRFTISCDTSKNTAYLQMNSLRAEDTAVYYCAAQDPWYPFYYWGQGTTVTVSS

SEQ ID NO: 198 - protein, 118 aa, Artificial Sequence
  Description of Artificial Sequence: Synthetic construct
EVQLVESGGGLVQPGGSLRLSCAASGFNIKDSTYIGWVRRAPGKGTELVAAIDCSGGYTRYADSVKGRFTISCDTSKNTAYLQMNSLRAEDTAVYYCASYYYYTFEYWGQGTTVTVSS

SEQ ID NO: 199 - protein, 118 aa, Artificial Sequence
  Description of Artificial Sequence: Synthetic construct
EVQLVESGGGLVQPGGSLRLSCAASSFNIKDTYIGWVRRAPGKGTELVAAIDCSNGDTRYADSVKGRFTISCDTSKNTAYLQMNSLRAEDTAVYYCAEHYYHYGFIYWGQGTTVTVSS

SEQ ID NO: 200 - protein, 119 aa, Artificial Sequence
  Description of Artificial Sequence: Synthetic construct
EVQLVESGGGLVQPGGSLRLSCAASGFNIKDSTYIGWVRRAPGKGTELVAIISCTDGETRYADSVKGRFTISCNTSKNTAYLQMNSLRAEDTAVYYCADHYYYHGFAYWGQGTTVTVSS

SEQ ID NO: 201 - protein, 7 aa, Artificial Sequence
  Description of Artificial Sequence: Synthetic construct
GFSFSSY

SEQ ID NO: 202 - protein, 3 aa, Artificial Sequence
  Description of Artificial Sequence: Synthetic construct
GGR

SEQ ID NO: 203 - protein, 9 aa, Artificial Sequence
  Description of Artificial Sequence: Synthetic construct
TGRVYFALD

SEQ ID NO: 204 - protein, 11 aa, Artificial Sequence
  Description of Artificial Sequence: Synthetic construct
SESVDTSDNSF

SEQ ID NO: 205 - protein, 3 aa, Artificial Sequence
  Description of Artificial Sequence: Synthetic construct
RSS

SEQ ID NO: 206 - protein, 6 aa, Artificial Sequence
  Description of Artificial Sequence: Synthetic construct
NYDVPW

SEQ ID NO: 207 - protein, 30 aa, Artificial Sequence
  Description of Artificial Sequence: Synthetic construct
EVQLVESGGGLVQPGGSLRLSCAASGFNIK

SEQ ID NO: 208 - protein, 14 aa, Artificial Sequence
  Description of Artificial Sequence: Synthetic construct
WVRRAPGKGTELVA

SEQ ID NO: 209 - protein, 32 aa, Artificial Sequence
  Description of Artificial Sequence: Synthetic construct
RFTISCDTSKNTAYLQMNSLRAEDTAVYYCAS

SEQ ID NO: 210 - protein, 11 aa, Artificial Sequence
  Description of Artificial Sequence: Synthetic construct
WGQGTTVTVSS

SEQ ID NO: 211 - protein, 30 aa, Artificial Sequence
  Description of Artificial Sequence: Synthetic construct
EVQLVESGGGLVQPGGSLRLSCAASSFNIK

SEQ ID NO: 212 - protein, 5 aa, Artificial Sequence
  Description of Artificial Sequence: Synthetic construct
DTYIG

SEQ ID NO: 213 - protein, 17 aa, Artificial Sequence
  Description of Artificial Sequence: Synthetic construct
SIDCIYGYTRYADSVKG

SEQ ID NO: 214 - protein, 7 aa, Artificial Sequence
  Description of Artificial Sequence: Synthetic construct
QGYRLHY

SEQ ID NO: 215 - protein, 5 aa, Artificial Sequence
  Description of Artificial Sequence: Synthetic construct
DTYIG

SEQ ID NO: 216 - protein, 17 aa, Artificial Sequence
  Description of Artificial Sequence: Synthetic construct
DIYCSEGSTRYADSVKG

SEQ ID NO: 217 - protein, 9 aa, Artificial Sequence
  Description of Artificial Sequence: Synthetic construct
VSDYVVFYY

SEQ ID NO: 218 - protein, 5 aa, Artificial Sequence
  Description of Artificial Sequence: Synthetic construct
DTYIG

SEQ ID NO: 219 - protein, 17 aa, Artificial Sequence
  Description of Artificial Sequence: Synthetic construct
GIYCEAGITRYADSVKG

SEQ ID NO: 220 - protein, 9 aa, Artificial Sequence
  Description of Artificial Sequence: Synthetic construct
KGIGNYFDY

SEQ ID NO: 221 - protein, 7 aa, Artificial Sequence
  Description of Artificial Sequence: Synthetic construct
GFNIKDG

SEQ ID NO: 222 - protein, 7 aa, Artificial Sequence
  Description of Artificial Sequence: Synthetic construct
ECTNGRA

SEQ ID NO: 223 - protein, 9 aa, Artificial Sequence
  Description of Artificial Sequence: Synthetic construct
AGIGYYFYY

SEQ ID NO: 224 - protein, 5 aa, Artificial Sequence
  Description of Artificial Sequence: Synthetic construct
QNCIE

SEQ ID NO: 225 - protein, 17 aa, Artificial Sequence
  Description of Artificial Sequence: Synthetic construct
NICHDIGSTRYADSVKG

SEQ ID NO: 226 - protein, 8 aa, Artificial Sequence
  Description of Artificial Sequence: Synthetic construct
WEQKGFNY

SEQ ID NO: 227 - protein, 7 aa, Artificial Sequence
  Description of Artificial Sequence: Synthetic construct
GFDIKRY

SEQ ID NO: 228 - protein, 6 aa, Artificial Sequence
  Description of Artificial Sequence: Synthetic construct
CNTDGS

SEQ ID NO: 229 - protein, 9 aa, Artificial Sequence
  Description of Artificial Sequence: Synthetic construct
EEWDQYFHY

SEQ ID NO: 230 - protein, 6 aa, Artificial Sequence
  Description of Artificial Sequence: Synthetic construct
DSTYIG

SEQ ID NO: 231 - protein, 17 aa, Artificial Sequence
  Description of Artificial Sequence: Synthetic construct
YISCYDGDTRYADSVKG

SEQ ID NO: 232 - protein, 9 aa, Artificial Sequence
  Description of Artificial Sequence: Synthetic construct
YYYYHGFAY

SEQ ID NO: 233 - protein, 5 aa, Artificial Sequence
  Description of Artificial Sequence: Synthetic construct
DYCIG

SEQ ID NO: 234 - protein, 17 aa, Artificial Sequence
  Description of Artificial Sequence: Synthetic construct
SICPEGGYTRYADSVKG

SEQ ID NO: 235 - protein, 8 aa, Artificial Sequence
  Description of Artificial Sequence: Synthetic construct
YGVYGFEY

SEQ ID NO: 236 - protein, 5 aa, Artificial Sequence
  Description of Artificial Sequence: Synthetic construct
DTYIG

SEQ ID NO: 237 - protein, 17 aa, Artificial Sequence
  Description of Artificial Sequence: Synthetic construct
AISCSTGDTRYADSVKG

SEQ ID NO: 238 - protein, 9 aa, Artificial Sequence
  Description of Artificial Sequence: Synthetic construct
QDPWYPFYY

SEQ ID NO: 239 - protein, 17 aa, Artificial Sequence
  Description of Artificial Sequence: Synthetic construct
AIDCSGGYTRYADSVKG

SEQ ID NO: 240 - protein, 8 aa, Artificial Sequence
  Description of Artificial Sequence: Synthetic construct
YYYYTFEY

SEQ ID NO: 241 - protein, 5 aa, Artificial Sequence
  Description of Artificial Sequence: Synthetic construct
DTYIG

SEQ ID NO: 242 - protein, 5 aa, Artificial Sequence
  Description of Artificial Sequence: Synthetic construct
DTYIG

SEQ ID NO: 243 - protein, 17 aa, Artificial Sequence
  Description of Artificial Sequence: Synthetic construct
AIDCSNGDTRYADSVKG

SEQ ID NO: 244 - protein, 9 aa, Artificial Sequence
  Description of Artificial Sequence: Synthetic construct
HYYHYGFIY

SEQ ID NO: 245 - protein, 6 aa, Artificial Sequence
  Description of Artificial Sequence: Synthetic construct
DSTYIG

SEQ ID NO: 246 - protein, 17 aa, Artificial Sequence
  Description of Artificial Sequence: Synthetic construct
IISCTDGETRYADSVKG

SEQ ID NO: 247 - protein, 9 aa, Artificial Sequence
  Description of Artificial Sequence: Synthetic construct
HYYYHGFAY

SEQ ID NO: 248 - protein, 19 aa, Artificial Sequence
  Description of Artificial Sequence: Synthetic construct
MDWTWRILFLVAAATGAHS

SEQ ID NO: 249 - protein, 19 aa, Artificial Sequence
  Description of Artificial Sequence: Synthetic construct
MGWSCIILFLVATATGVHS

SEQ ID NO: 250 - protein, 427 aa, Artificial Sequence
  Description of Artificial Sequence: Synthetic construct
KLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDSASYKCETQNPVSARRSDSVILNVLYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNITLSINPVKREDAGTYWCEVFNPISKNQSDPIMLNVNYNALPQENLINVDEQLYFQGGSGLNDIFEAQKIEWHEARAHHHHHH

SEQ ID NO: 251 - protein, 380 aa, Artificial Sequence
  Description of Artificial Sequence: Synthetic construct
NKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGKSGGLNDIFEAQKIEWHE

SEQ ID NO: 252 - protein, 363 aa, Artificial Sequence
  Description of Artificial Sequence: Synthetic construct
NKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 253 - protein, 768 aa, Artificial Sequence
  Description of Artificial Sequence: Synthetic construct
RPSRVHNSEENTMRALTLKDILNGTFSYKTFFPNWISGQEYLHQSADNNIVLYNIETGQSYTILSNRTMKSVNASNYGLSPDRQFVYLESDYSKLWRYSYTATYYIYDLSNGEFVRGNELPRPIQYLCWSPVGSKLAYVYQNNIYLKQRPGDPPFQITFNGRENKIFNGIPDWVYEEEMLATKYALWWSPNGKFLAYAEFNDTDIPVIAYSYYGDEQYPRTINIPYPKAGAKNPVVRIFIIDTTYPAYVGPQEVPVPAMIASSDYYFSWLTWVTDERVCLQWLKRVQNVSVLSICDFREDWQTWDCPKTQEHIEESRTGWAGGFFVSTPVFSYDAISYYKIFSDKDGYKHIHYIKDTVENAIQITSGKWEAINIFRVTQDSLFYSSNEFEEYPGRRNIYRISIGSYPPSKKCVTCHLRKERCQYYTASFSDYAKYYALVCYGPGIPISTLHDGRTDQEIKILEENKELENALKNIQLPKEEIKKLEVDEITLWYKMILPPQFDRSKKYPLLIQVYGGPCSQSVRSVFAVNWISYLASKEGMVIALVDGRGTAFQGDKLLYAVYRKLGVYEVEDQITAVRKFIEMGFIDEKRIAIWGWSYGGYVSSLALASGTGLFKCGIAVAPVSSWEYYASVYTERFMGLPTKDDNLEHYKNSTVMARAEYFRNVDYLLIHGTADDNVHFQNSAQIAKALVNAQVDFQAMWYSDQNHGLSGLSTNHLYTHMTHFLKQCFSLSVDEQLYFQGGSGLNDIFEAQKIEWHEARAHHHHHH

SEQ ID NO: 254 - protein, 770 aa, Artificial Sequence
  Description of Artificial Sequence: Synthetic construct
RPSRVYKPEGNTKRALTLKDILNGTFSYKTYFPNWISEQEYLHQSEDDNIVFYNIETRESYIILSNSTMKSVNATDYGLSPDRQFVYLESDYSKLWRYSYTATYYIYDLQNGEFVRGYELPRPIQYLCWSPVGSKLAYVYQNNIYLKQRPGDPPFQITYTGRENRIFNGIPDWVYEEEMLATKYALWWSPDGKFLAYVEFNDSDIPIIAYSYYGDGQYPRTINIPYPKAGAKNPVVRVFIVDTTYPHHVGPMEVPVPEMIASSDYYFSWLTWVSSERVCLQWLKRVQNVSVLSICDFREDWHAWECPKNQEHVEESRTGWAGGFFVSTPAFSQDATSYYKIFSDKDGYKHIHYIKDTVENAIQITSGKWEAIYIFRVTQDSLFYSSNEFEGYPGRRNIYRISIGNSPPSKKCVTCHLRKERCQYYTASFSYKAKYYALVCYGPGLPISTLHDGRTDQEIQVLEENKELENSLRNIQLPKVEIKKLKDGGLTFWYKMILPPQFDRSKKYPLLIQVYGGPCSQSVKSVFAVNWITYLASKEGIVIALVDGRGTAFQGDKFLHAVYRKLGVYEVEDQLTAVRKFIEMGFIDEERIAIWGWSYGGYVSSLALASGTGLFKCGIAVAPVSSWEYYASIYSERFMGLPTKDDNLEHYKNSTVMARAEYFRNVDYLLIHGTADDNVHFQNSAQIAKALVNAQVDFQAMWYSDQNHGILSGRSQNHLYTHMTHFLKQCFSLSDVDEQLYFQGGSGLNDIFEAQKIEWHEARAHHHHHH

SEQ ID NO: 255 - protein, 428 aa, Artificial Sequence
  Description of Artificial Sequence: Synthetic construct
QLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAMAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNITLSINPVKREDAGTYWCEVFNPISKNQSDPIMLNVNYNALPQENLINVDLEVLFQGPGSGLNDIFEAQKIEWHEARAHHHHHH

SEQ ID NO: 256 - protein, 118 aa, Artificial Sequence
  Description of Artificial Sequence: Synthetic construct
EVQLVESGGGLVQPGGSLRLSCAASSFNIKDTYIGWVRRAPGKEEELVAEIYCDIGYTRYADSVKGRFTISCDTSKNTAYLQMNSLRAEDTAVYYCAAVEVAEYYEYWGQGTTVTVSS

SEQ ID NO: 257 - protein, 120 aa, Artificial Sequence
  Description of Artificial Sequence: Synthetic construct
EVQLVESGGGLVQPGGSLRLSCAASGFNIKDSSTYIGWVRRAPGKEEELVAEIYCDIGYTRYADSVKGRFTISCDTSKNTAYLQMNSLRAEDTAVYYCAAVEVAEYYEYWGQGTTVTVSS

SEQ ID NO: 258 - protein, 118 aa, Artificial Sequence
  Description of Artificial Sequence: Synthetic construct
EVQLVESGGGLVQPGGSLRLSCAASGFNIKDTCIGWVRRAPGKEEELVAEICQDIGYTRYADSVKGRFTISADTSKNTAYLQMNSLRAEDTAVYYCAAVEVAEYYEYWGQGTTVTVSS

SEQ ID NO: 259 - protein, 227 aa, Artificial Sequence
  Description of Artificial Sequence: Synthetic construct
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNRFTQKSLSLSPGK

SEQ ID NO: 260 - protein, 118 aa, Artificial Sequence
  Description of Artificial Sequence: Synthetic construct
EVQLVESGGGLVQPGGSLRLSCAASGFNIKDTCIGWVRRAPGKEEELVANICITDGKTRYADSVKGRFTISADTSKNTAYLQMNSLRAEDTAVYYCAYYSKYIGYRYWGQGTTVTVSS

SEQ ID NO: 261 - protein, 118 aa, Artificial Sequence
  Description of Artificial Sequence: Synthetic construct
EVQLVESGGGLVQPGGSLRLSCAASGFNIKDTCIGWVRRAPGKEEELVANICQSGGYTRYADSVKGRFTISADTSKNTAYLQMNSLRAEDTAVYYCARYHKGVGYQYWGQGTTVTVSS

SEQ ID NO: 262 - protein, 118 aa, Artificial Sequence
  Description of Artificial Sequence: Synthetic construct
EVQLVESGGGLVQPGGSLRLSCAASSFNIKDTYIGWVRRAPGKEEELVAKIFRCSDGRTRYADSVKGRFTISCDTSKNTAYLQMNSLRAEDTAVYYCANIYKTHYTYWGQGTTVTVSS

SEQ ID NO: 263 - protein, 117 aa, Artificial Sequence
  Description of Artificial Sequence: Synthetic construct
EVQLVESGGGLVQPGGSLRLSCAASGFNIKDTCIGWVRRAPGKEEELVANICGHIGSTRYADSVKGRFTISADTSKNTAYLQMNSLRAEDTAVYYCANSYTYSYKYWGQGTTVTVSS

SEQ ID NO: 264 - protein, 118 aa, Artificial Sequence
  Description of Artificial Sequence: Synthetic construct
EVQLVESGGGLVQPGGSLRLSCAASGFNIKDTCIGWVRRAPGKEEELVANICGQYGQTRYADSVKGRFTISADTSKNTAYLQMNSLRAEDTAVYYCAKSGGRHGYEYWGQGTTVTVSS

SEQ ID NO: 265 - protein, 118 aa, Artificial Sequence
  Description of Artificial Sequence: Synthetic construct
EVQLVESGGGLVQPGGSLRLSCAASGFNIKDTCIGWVRRAPGKEEELVANICGTTGSTRYADSVKGRFTISADTSKNTAYLQMNSLRAEDTAVYYCANSWTIYRYKYWGQGTTVTVSS

SEQ ID NO: 266 - protein, 118 aa, Artificial Sequence
  Description of Artificial Sequence: Synthetic construct
EVQLVESGGGLVQPGGSLRLSCAASSFNIKDTYIGWVRRAPGKEEELVANIHCRSGYTRYADSVKGRFTISCDTSKNTAYLQMNSLRAEDTAVYYCAHSGSRYIYKYWGQGTTVTVSS

SEQ ID NO: 267 - protein, 118 aa, Artificial Sequence
  Description of Artificial Sequence: Synthetic construct
EVQLVESGGGLVQPGGSLRLSCAASGFNIKDTCIGWVRRAPGKEEELVANICGSIGATRYADSVKGRFTISADTSKNTAYLQMNSLRAEDTAVYYCAKSGGHKGYRYWGQGTTVTVSS

SEQ ID NO: 268 - protein, 118 aa, Artificial Sequence
  Description of Artificial Sequence: Synthetic construct
EVQLVESGGGLVQPGGSLRLSCAASGFNIKDTCIGWVRRAPGKEEELVANICGGDGHTRYADSVKGRFTISADTSKNTAYLQMNSLRAEDTAVYYCATSYTVYRYYYWGQGTTVTVSS

SEQ ID NO: 269 - protein, 118 aa, Artificial Sequence
  Description of Artificial Sequence: Synthetic construct
EVQLVESGGGLVQPGGSLRLSCAASGFNIKDTCIGWVRRAPGKEEELVANICGITGYTRYADSVKGRFTISADTSKNTAYLQMNSLRAEDTAVYYCAKSGGPKGYTYWGQGTTVTVSS

SEQ ID NO: 270 - protein, 118 aa, Artificial Sequence
  Description of Artificial Sequence: Synthetic construct
EVQLVESGGGLVQPGGSLRLSCAASGFNIKDTCIGWVRRAPGKEEELVANICSSYGHTRYADSVKGRFTISADTSKNTAYLQMNSLRAEDTAVYYCASSYTIYRYSYWGQGTTVTVSS

SEQ ID NO: 271 - protein, 121 aa, Artificial Sequence
  Description of Artificial Sequence: Synthetic construct
EVQLVESGGGLVQPGGSLRLSCAASGFNIKDSSTYIGWVRRAPGKEEELVARIQCSSGSTRYADSVKGRFTISCDTSKNTAYLQMNSLRAEDTAVYYCAGRQSYNYGYIYWGQGTTVTVSS

SEQ ID NO: 272 - protein, 118 aa, Artificial Sequence
  Description of Artificial Sequence: Synthetic construct
EVQLVESGGGLVQPGGSLRLSCAASGFNIKDTCIGWVRRAPGKEEELVANICGKIGITRYADSVKGRFTISADTSKNTAYLQMNSLRAEDTAVYYCANSYTIVRYDYWGQGTTVTVSS

SEQ ID NO: 273 - protein, 119 aa, Artificial Sequence
  Description of Artificial Sequence: Synthetic construct
EVQLVESGGGLVQPGGSLRLSCAASGFNIKDTCIGWVRRAPGKEEELVANICPKHGATRYADSVKGRFTISADTSKNTAYLQMNSLRAEDTAVYYCAYSGNVYNRYKYWGQGTTVTVSS

SEQ ID NO: 274 - protein, 118 aa, Artificial Sequence
  Description of Artificial Sequence: Synthetic construct
EVQLVESGGGLVQPGGSLRLSCAASSFNIKDTYIGWVRRAPGKEEELVANIYCNYGYTRYADSVKGRFTISCDTSKNTAYLQMNSLRAEDTAVYYCATSHTRYHYKYWGQGTTVTVSS

SEQ ID NO: 275 - protein, 119 aa, Artificial Sequence
  Description of Artificial Sequence: Synthetic construct
EVQLVESGGGLVQPGGSLRLSCAASGFNIKDTCIGWVRRAPGKEEELVARICGQIGSTRYADSVKGRFTISADTSKNTAYLQMNSLRAEDTAVYYCATSYTVYRSYDYWGQGTTVTVSS

SEQ ID NO: 276 - protein, 119 aa, Artificial Sequence
  Description of Artificial Sequence: Synthetic construct
EVQLVESGGGLVQPGGSLRLSCAASGFNIKDTCIGWVRRAPGKEEELVANICGSYGHTRYADSVKGRFTISADTSKNTAYLQMNSLRAEDTAVYYCASSYTVYRSYAYWGQGTTVTVSS

SEQ ID NO: 277 - protein, 119 aa, Artificial Sequence
  Description of Artificial Sequence: Synthetic construct
EVQLVESGGGLVQPGGSLRLSCAASGFNIKDTCIGWVRRAPGKEEELVANICGSNGYTRYADSVKGRFTISADTSKNTAYLQMNSLRAEDTAVYYCASSYTVYRGYDYWGQGTTVTVSS

SEQ ID NO: 278 - protein, 118 aa, Artificial Sequence
  Description of Artificial Sequence: Synthetic construct
EVQLVESGGGLVQPGGSLRLSCAASGFNIKDTCIGWVRRAPGKEEELVANICQTHGYTRYADSVKGRFTISADTSKNTAYLQMNSLRAEDTAVYYCAYKGGGRYYDYWGQGTTVTVSS

SEQ ID NO: 279 - protein, 121 aa, Artificial Sequence
  Description of Artificial Sequence: Synthetic construct
EVQLVESGGGLVQPGGSLRLSCAASGFNIKDSSTYIGWVRRAPGKEEELVARIQCSAGSTRYADSVKGRFTISCDTSKNTAYLQMNSLRAEDTAVYYCAGRSARSYSYIYWGQGTTVTVSS

SEQ ID NO: 280 - protein, 355 aa, Artificial Sequence
  Description of Artificial Sequence: Synthetic construct
EVQLVESGGGLVQPGGSLRLSCAASGFNIKDTCIGWVRRAPGKEEELVANICITDGKTRYADSVKGRFTISADTSKNTAYLQMNSLRAEDTAVYYCAYYSKYIGYRYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 281 - protein, 355 aa, Artificial Sequence
  Description of Artificial Sequence: Synthetic construct
EVQLVESGGGLVQPGGSLRLSCAASGFNIKDTCIGWVRRAPGKEEELVANICQSGGYTRYADSVKGRFTISADTSKNTAYLQMNSLRAEDTAVYYCARYHKGVGYQYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 282 - protein, 355 aa, Artificial Sequence
  Description of Artificial Sequence: Synthetic construct
EVQLVESGGGLVQPGGSLRLSCAASSFNIKDTYIGWVRRAPGKEEELVAKIFRCSDGRTRYADSVKGRFTISCDTSKNTAYLQMNSLRAEDTAVYYCANIYKTHYTYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 283 - protein, 354 aa, Artificial Sequence
  Description of Artificial Sequence: Synthetic construct
EVQLVESGGGLVQPGGSLRLSCAASGFNIKDTCIGWVRRAPGKEEELVANICGHIGSTRYADSVKGRFTISADTSKNTAYLQMNSLRAEDTAVYYCANSYTYSYKYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 284 - protein, 355 aa, Artificial Sequence
  Description of Artificial Sequence: Synthetic construct
EVQLVESGGGLVQPGGSLRLSCAASGFNIKDTCIGWVRRAPGKEEELVANICGQYGQTRYADSVKGRFTISADTSKNTAYLQMNSLRAEDTAVYYCAKSGGRHGYEYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 285 - protein, 355 aa, Artificial Sequence
  Description of Artificial Sequence: Synthetic construct
EVQLVESGGGLVQPGGSLRLSCAASGFNIKDTCIGWVRRAPGKEEELVANICGTTGSTRYADSVKGRFTISADTSKNTAYLQMNSLRAEDTAVYYCANSWTIYRYKYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 286 - protein, 355 aa, Artificial Sequence
  Description of Artificial Sequence: Synthetic construct
EVQLVESGGGLVQPGGSLRLSCAASSFNIKDTYIGWVRRAPGKEEELVANIHCRSGYTRYADSVKGRFTISCDTSKNTAYLQMNSLRAEDTAVYYCAHSGSRYIYKYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 287 - protein, 355 aa, Artificial Sequence
  Description of Artificial Sequence: Synthetic construct
EVQLVESGGGLVQPGGSLRLSCAASGFNIKDTCIGWVRRAPGKEEELVANICGSIGATRYADSVKGRFTISADTSKNTAYLQMNSLRAEDTAVYYCAKSGGHKGYRYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 288 - protein, 355 aa, Artificial Sequence
  Description of Artificial Sequence: Synthetic construct
EVQLVESGGGLVQPGGSLRLSCAASGFNIKDTCIGWVRRAPGKEEELVANICGGDGHTRYADSVKGRFTISADTSKNTAYLQMNSLRAEDTAVYYCATSYTVYRYYYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 289 - protein, 355 aa, Artificial Sequence
  Description of Artificial Sequence: Synthetic construct
EVQLVESGGGLVQPGGSLRLSCAASGFNIKDTCIGWVRRAPGKEEELVANICGITGYTRYADSVKGRFTISADTSKNTAYLQMNSLRAEDTAVYYCAKSGGPKGYTYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 290 - protein, 355 aa, Artificial Sequence
  Description of Artificial Sequence: Synthetic construct
EVQLVESGGGLVQPGGSLRLSCAASGFNIKDTCIGWVRRAPGKEEELVANICSSYGHTRYADSVKGRFTISADTSKNTAYLQMNSLRAEDTAVYYCASSYTIYRYSYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 291 - protein, 358 aa, Artificial Sequence
  Description of Artificial Sequence: Synthetic construct
EVQLVESGGGLVQPGGSLRLSCAASGFNIKDSSTYIGWVRRAPGKEEELVARIQCSSGSTRYADSVKGRFTISCDTSKNTAYLQMNSLRAEDTAVYYCAGRQSYNYGYIYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 292 - protein, 355 aa, Artificial Sequence
  Description of Artificial Sequence: Synthetic construct
EVQLVESGGGLVQPGGSLRLSCAASGFNIKDTCIGWVRRAPGKEEELVANICGKIGITRYADSVKGRFTISADTSKNTAYLQMNSLRAEDTAVYYCANSYTIVRYDYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 293 - protein, 356 aa, Artificial Sequence
  Description of Artificial Sequence: Synthetic construct
EVQLVESGGGLVQPGGSLRLSCAASGFNIKDTCIGWVRRAPGKEEELVANICPKHGATRYADSVKGRFTISADTSKNTAYLQMNSLRAEDTAVYYCAYSGNVYNRYKYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 294 - protein, 355 aa, Artificial Sequence
  Description of Artificial Sequence: Synthetic construct
EVQLVESGGGLVQPGGSLRLSCAASSFNIKDTYIGWVRRAPGKEEELVANIYCNYGYTRYADSVKGRFTISCDTSKNTAYLQMNSLRAEDTAVYYCATSHTRYHYKYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 295 - protein, 356 aa, Artificial Sequence
  Description of Artificial Sequence: Synthetic construct
EVQLVESGGGLVQPGGSLRLSCAASGFNIKDTCIGWVRRAPGKEEELVARICGQIGSTRYADSVKGRFTISADTSKNTAYLQMNSLRAEDTAVYYCATSYTVYRSYDYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 296 - protein, 356 aa, Artificial Sequence
  Description of Artificial Sequence: Synthetic construct
EVQLVESGGGLVQPGGSLRLSCAASGFNIKDTCIGWVRRAPGKEEELVANICGSYGHTRYADSVKGRFTISADTSKNTAYLQMNSLRAEDTAVYYCASSYTVYRSYAYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 297 - protein, 356 aa, Artificial Sequence
  Description of Artificial Sequence: Synthetic construct
EVQLVESGGGLVQPGGSLRLSCAASGFNIKDTCIGWVRRAPGKEEELVANICGSNGYTRYADSVKGRFTISADTSKNTAYLQMNSLRAEDTAVYYCASSYTVYRGYDYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 298 - protein, 355 aa, Artificial Sequence
  Description of Artificial Sequence: Synthetic construct
EVQLVESGGGLVQPGGSLRLSCAASGFNIKDTCIGWVRRAPGKEEELVANICQTHGYTRYADSVKGRFTISADTSKNTAYLQMNSLRAEDTAVYYCAYKGGGRYYDYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 299 - protein, 358 aa, Artificial Sequence
  Description of Artificial Sequence: Synthetic construct
EVQLVESGGGLVQPGGSLRLSCAASGFNIKDSSTYIGWVRRAPGKEEELVARIQCSAGSTRYADSVKGRFTISCDTSKNTAYLQMNSLRAEDTAVYYCAGRSARSYSYIYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 300 - protein, 119 aa, Artificial Sequence
  Description of Artificial Sequence: Synthetic construct
EVQLVESGGGLVQPGGSLRLSCAASGFNIKDTCIGWVRRAPGKEEELVAKICKYSGHTRYADSVKGRFTISADTSKNTAYLQMNSLRAEDTAVYYCAAVSVRDGHYNYWGQGTTVTVSS

SEQ ID NO: 301 - protein, 119 aa, Artificial Sequence
  Description of Artificial Sequence: Synthetic construct
EVQLVESGGGLVQPGGSLRLSCAASGFNIKDTCIGWVRRAPGKEEELVADICPYKGSTRYADSVKGRFTISADTSKNTAYLQMNSLRAEDTAVYYCAIVSARDGYYNYWGQGTTVTVSS

SEQ ID NO: 302 - protein, 119 aa, Artificial Sequence
  Description of Artificial Sequence: Synthetic construct
EVQLVESGGGLVQPGGSLRLSCAASGFNIKDTCIGWVRRAPGKEEELVAYICNYTGYTRYADSVKGRFTISADTSKNTAYLQMNSLRAEDTAVYYCAITSYHGQGYNYWGQGTTVTVSS

SEQ ID NO: 303 - protein, 119 aa, Artificial Sequence
  Description of Artificial Sequence: Synthetic construct
EVQLVESGGGLVQPGGSLRLSCAASGFNIKDTCIGWVRRAPGKEEELVANICPYHGYTRYADSVKGRFTISADTSKNTAYLQMNSLRAEDTAVYYCAIVSYVDEYYNYWGQGTTVTVSS

SEQ ID NO: 304 - protein, 118 aa, Artificial Sequence
  Description of Artificial Sequence: Synthetic construct
EVQLVESGGGLVQPGGSLRLSCAASGFNIKDTCIGWVRRAPGKEEELVASICQYSGYTRYADSVKGRFTISADTSKNTAYLQMNSLRAEDTAVYYCAITSHHGDYNYWGQGTTVTVSS

SEQ ID NO: 305 - protein, 119 aa, Artificial Sequence
  Description of Artificial Sequence: Synthetic construct
EVQLVESGGGLVQPGGSLRLSCAASGFNIKDTCIGWVRRAPGKEEELVADICPSYGGTRYADSVKGRFTISADTSKNTAYLQMNSLRAEDTAVYYCAIVSKIDQYYNYWGQGTTVTVSS

SEQ ID NO: 306 - protein, 119 aa, Artificial Sequence
  Description of Artificial Sequence: Synthetic construct
EVQLVESGGGLVQPGGSLRLSCAASGFNIKDSSTYIGWVRRAPGKEEELVASISCSRGNTRYADSVKGRFTISCDTSKNTAYLQMNSLRAEDTAVYYCAHPRYTWYDYWGQGTTVTVSS

SEQ ID NO: 307 - protein, 119 aa, Artificial Sequence
  Description of Artificial Sequence: Synthetic construct
EVQLVESGGGLVQPGGSLRLSCAASGFNIKDTCIGWVRRAPGKEEELVAAICPYKGYTRYADSVKGRFTISADTSKNTAYLQMNSLRAEDTAVYYCANVAYSGGHYNYWGQGTTVTVSS

SEQ ID NO: 308 - protein, 119 aa, Artificial Sequence
  Description of Artificial Sequence: Synthetic construct
EVQLVESGGGLVQPGGSLRLSCAASGFNIKDTCIGWVRRAPGKEEELVAAICPYIGETRYADSVKGRFTISADTSKNTAYLQMNSLRAEDTAVYYCATVARKYNQYNYWGQGTTVTVSS

SEQ ID NO: 309 - protein, 119 aa, Artificial Sequence
  Description of Artificial Sequence: Synthetic construct
EVQLVESGGGLVQPGGSLRLSCAASGFNIKDTCIGWVRRAPGKEEELVAQICQYHGSTRYADSVKGRFTISADTSKNTAYLQMNSLRAEDTAVYYCAIVGQNYPVYNYWGQGTTVTVSS

SEQ ID NO: 310 - protein, 119 aa, Artificial Sequence
  Description of Artificial Sequence: Synthetic construct
EVQLVESGGGLVQPGGSLRLSCAASGFNIKDTCIGWVRRAPGKEEELVAAICEYKGYTRYADSVKGRFTISADTSKNTAYLQMNSLRAEDTAVYYCAIASPVDQYYNYWGQGTTVTVSS

SEQ ID NO: 311 - protein, 119 aa, Artificial Sequence
  Description of Artificial Sequence: Synthetic construct
EVQLVESGGGLVQPGGSLRLSCAASGFNIKDTCIGWVRRAPGKEEELVASICKYTGKTRYADSVKGRFTISADTSKNTAYLQMNSLRAEDTAVYYCAIVASGDGWYNYWGQGTTVTVSS

SEQ ID NO: 312 - protein, 119 aa, Artificial Sequence
  Description of Artificial Sequence: Synthetic construct
EVQLVESGGGLVQPGGSLRLSCAASGFNIKDTCIGWVRRAPGKEEELVAAICTYKGTTRYADSVKGRFTISADTSKNTAYLQMNSLRAEDTAVYYCAIYSHYYDYYNYWGQGTTVTVSS

SEQ ID NO: 313 - protein, 119 aa, Artificial Sequence
  Description of Artificial Sequence: Synthetic construct
EVQLVESGGGLVQPGGSLRLSCAASGFNIKDTCIGWVRRAPGKEEELVAGICEYTGSTRYADSVKGRFTISADTSKNTAYLQMNSLRAEDTAVYYCAIVSQSRSVYNYWGQGTTVTVSS

SEQ ID NO: 314 - protein, 356 aa, Artificial Sequence
  Description of Artificial Sequence: Synthetic construct
EVQLVESGGGLVQPGGSLRLSCAASGFNIKDTCIGWVRRAPGKEEELVAKICKYSGHTRYADSVKGRFTISADTSKNTAYLQMNSLRAEDTAVYYCAAVSVRDGHYNYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 315 - protein, 356 aa, Artificial Sequence
  Description of Artificial Sequence: Synthetic construct
EVQLVESGGGLVQPGGSLRLSCAASGFNIKDTCIGWVRRAPGKEEELVADICPYKGSTRYADSVKGRFTISADTSKNTAYLQMNSLRAEDTAVYYCAIVSARDGYYNYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 316 - protein, 356 aa, Artificial Sequence
  Description of Artificial Sequence: Synthetic construct
EVQLVESGGGLVQPGGSLRLSCAASGFNIKDTCIGWVRRAPGKEEELVAYICNYTGYTRYADSVKGRFTISADTSKNTAYLQMNSLRAEDTAVYYCAITSYHGQGYNYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 317 - protein, 356 aa, Artificial Sequence
  Description of Artificial Sequence: Synthetic construct
EVQLVESGGGLVQPGGSLRLSCAASGFNIKDTCIGWVRRAPGKEEELVANICPYHGYTRYADSVKGRFTISADTSKNTAYLQMNSLRAEDTAVYYCAIVSYVDEYYNYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 318 - protein, 355 aa, Artificial Sequence
  Description of Artificial Sequence: Synthetic construct
EVQLVESGGGLVQPGGSLRLSCAASGFNIKDTCIGWVRRAPGKEEELVASICQYSGYTRYADSVKGRFTISADTSKNTAYLQMNSLRAEDTAVYYCAITSHHGDYNYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 319 - protein, 356 aa, Artificial Sequence
  Description of Artificial Sequence: Synthetic construct
EVQLVESGGGLVQPGGSLRLSCAASGFNIKDTCIGWVRRAPGKEEELVADICPSYGGTRYADSVKGRFTISADTSKNTAYLQMNSLRAEDTAVYYCAIVSKIDQYYNYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 320 - protein, 356 aa, Artificial Sequence
  Description of Artificial Sequence: Synthetic construct
EVQLVESGGGLVQPGGSLRLSCAASGFNIKDSSTYIGWVRRAPGKEEELVASISCSRGNTRYADSVKGRFTISCDTSKNTAYLQMNSLRAEDTAVYYCAHPRYTWYDYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 321 - protein, 356 aa, Artificial Sequence
  Description of Artificial Sequence: Synthetic construct
EVQLVESGGGLVQPGGSLRLSCAASGFNIKDTCIGWVRRAPGKEEELVAAICPYKGYTRYADSVKGRFTISADTSKNTAYLQMNSLRAEDTAVYYCANVAYSGGHYNYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 322 - protein, 356 aa, Artificial Sequence
  Description of Artificial Sequence: Synthetic construct
EVQLVESGGGLVQPGGSLRLSCAASGFNIKDTCIGWVRRAPGKEEELVAAICPYIGETRYADSVKGRFTISADTSKNTAYLQMNSLRAEDTAVYYCATVARKYNQYNYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 323 - protein, 356 aa, Artificial Sequence
  Description of Artificial Sequence: Synthetic construct
EVQLVESGGGLVQPGGSLRLSCAASGFNIKDTCIGWVRRAPGKEEELVAQICQYHGSTRYADSVKGRFTISADTSKNTAYLQMNSLRAEDTAVYYCAIVGQNYPVYNYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 324 - protein, 356 aa, Artificial Sequence
  Description of Artificial Sequence: Synthetic construct
EVQLVESGGGLVQPGGSLRLSCAASGFNIKDTCIGWVRRAPGKEEELVAAICEYKGYTRYADSVKGRFTISADTSKNTAYLQMNSLRAEDTAVYYCAIASPVDQYYNYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 325 - protein, 356 aa, Artificial Sequence
  Description of Artificial Sequence: Synthetic construct
EVQLVESGGGLVQPGGSLRLSCAASGFNIKDTCIGWVRRAPGKEEELVASICKYTGKTRYADSVKGRFTISADTSKNTAYLQMNSLRAEDTAVYYCAIVASGDGWYNYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 326 - protein, 356 aa, Artificial Sequence
  Description of Artificial Sequence: Synthetic construct
EVQLVESGGGLVQPGGSLRLSCAASGFNIKDTCIGWVRRAPGKEEELVAAICTYKGTTRYADSVKGRFTISADTSKNTAYLQMNSLRAEDTAVYYCAIYSHYYDYYNYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 327 - protein, 356 aa, Artificial Sequence
  Description of Artificial Sequence: Synthetic construct
EVQLVESGGGLVQPGGSLRLSCAASGFNIKDTCIGWVRRAPGKEEELVAGICEYTGSTRYADSVKGRFTISADTSKNTAYLQMNSLRAEDTAVYYCAIVSQSRSVYNYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 328 - protein, 119 aa, Artificial Sequence
  Description of Artificial Sequence: Synthetic construct
EVQLVESGGGLVQPGGSLRLSCAASGFNIKDTCIGWVRRAPGKEEELVAYICPSHGYTRYADSVKGRFTISADTSKNTAYLQMNSLRAEDTAVYYCADHKNTQWGYAYWGQGTTVTVSS

SEQ ID NO: 329 - protein, 118 aa, Artificial Sequence
  Description of Artificial Sequence: Synthetic construct
EVQLVESGGGLVQPGGSLRLSCAASGFNIKDTCIGWVRRAPGKEEELVAAICKTQGDTRYADSVKGRFTISADTSKNTAYLQMNSLRAEDTAVYYCAAANYDSPYTYWGQGTTVTVSS

SEQ ID NO: 330 - protein, 118 aa, Artificial Sequence
  Description of Artificial Sequence: Synthetic construct
EVQLVESGGGLVQPGGSLRLSCAASGFNIKDTCIGWARRAPGKEEELVAAICDYNGHTRYADSVKGRFTISADTSKNTAYLQMNSLRAEDTAVYYCAQSDYDSKYSYWGQGTTVTVSS

SEQ ID NO: 331 - protein, 119 aa, Artificial Sequence
  Description of Artificial Sequence: Synthetic construct
EVQLVESGGGLVQPGGSLRLSCAASGFNIKDTCIGWVRRAPGKEEELVAYICEGNGYTRYADSVKGRFTISADTSKNTAYLQMNSLRAEDTAVYYCAAEGKETYYYQYWGQGTTVTVSS

SEQ ID NO: 332 - protein, 118 aa, Artificial Sequence
  Description of Artificial Sequence: Synthetic construct
EVQLVESGGGLVQPGGSLRLSCAASGFNIKDTCIGWVRRAPGKEEELVAGICRDGGDTRYADSVKGRFTISADTSKNTAYLQMNSLRAEDTAVYYCAASDYDSYYAYWGQGTTVTVSS

SEQ ID NO: 333 - protein, 119 aa, Artificial Sequence
  Description of Artificial Sequence: Synthetic construct
EVQLVESGGGLVQPGGSLRLSCAASGFNIKDTCIGWVRRAPGKEEELVADICIKHGYTRYADSVKGRFTISADTSKNTAYLQMNSLRAEDTAVYYCADWTQSGYHYGYWGQGTTVTVSS

SEQ ID NO: 334 - protein, 118 aa, Artificial Sequence
  Description of Artificial Sequence: Synthetic construct
EVQLVESGGGLVQPGGSLRLSCAASGFNIKDTCIGWVRRAPGKEEELVAAICPDEGDTRYADSVKGRFTISADTSKNTAYLQMNSLRAEDTAVYYCAAAKYDDRYNYWGQGTTVTVSS

SEQ ID NO: 335 - protein, 120 aa, Artificial Sequence
  Description of Artificial Sequence: Synthetic construct
EVQLVESGGGLVQPGGSLRLSCAASGFNIKDSSTYIGWVRRAPGKEEELVAYIYCTQGETRYADSVKGRFTISCDTSKNTAYLQMNSLRAEDTAVYYCASWGGNYPYYYWGQGTTVTVSS

SEQ ID NO: 336 - protein, 119 aa, Artificial Sequence
  Description of Artificial Sequence: Synthetic construct
EVQLVESGGGLVQPGGSLRLSCAASGFNIKDTCIGWVRRAPGKEEELVARICGEYGSTRYADSVKGRFTISADTSKNTAYLQMNSLRAEDTAVYYCAAQPRYYDVYDYWGQGTTVTVSS

SEQ ID NO: 337 - protein, 118 aa, Artificial Sequence
  Description of Artificial Sequence: Synthetic construct
EVQLVESGGGLVQPGGSLRLSCAASGFNIKDTCIGWVRRAPGKEEELVAAICYTQGDTRYADSVKGRFTISADTSKNTAYLQMNSLRAEDTAVYYCAASQYDSYYTYWGQGTTVTVSS

SEQ ID NO: 338 - protein, 118 aa, Artificial Sequence
  Description of Artificial Sequence: Synthetic construct
EVQLVESGGGLVQPGGSLRLSCAASGFNIKDTCIGWVRRAPGKEEELVAGICEAGGDTRYADSVKGRFTISADTSKNTAYLQMNSLRAEDTAVYYCAESQQGSYYSYWGQGTTVTVSS

SEQ ID NO: 339 - protein, 118 aa, Artificial Sequence
  Description of Artificial Sequence: Synthetic construct
EVQLVESGGGLVQPGGSLRLSCAASGFNIKDTCIGWVRRAPGKEEELVAGICYTYGDTRYADSVKGRFTISADTSKNTAYLQMNSLRAEDTAVYYCASSEVDSYYSYWGQGTTVTVSS

SEQ ID NO: 340 - protein, 118 aa, Artificial Sequence
  Description of Artificial Sequence: Synthetic construct
EVQLVESGGGLVQPGGSLRLSCAASGFNIKDTCIGWVRRAPGKEEELVAAICDSGGDTRYADSVKGRFTISADTSKNTAYLQMNSLRAEDTAVYYCAASDYNSHYSYWGQGTTVTVSS

SEQ ID NO: 341 - protein, 118 aa, Artificial Sequence
  Description of Artificial Sequence: Synthetic construct
EVQLVESGGGLVQPGGSLRLSCAASGFNIKDTCIGWVRRAPGKEEELVAAICHHGGDTRYADSVKGRFTISADTSKNTAYLQMNSLRAEDTAVYYCAESQVDSYYSYWGQGTTVTVSS

SEQ ID NO: 342 - protein, 119 aa, Artificial Sequence
  Description of Artificial Sequence: Synthetic construct
EVQLVESGGGLVQPGGSLRLSCAASGFNIKDTCIGWVRRAPGKEEELVAEICGRYGSTRYADSVKGRFTISADTSKNTAYLQMNSLRAEDTAVYYCAAEHRYPGQYTYWGQGTTVTVSS

SEQ ID NO: 343 - protein, 118 aa, Artificial Sequence
  Description of Artificial Sequence: Synthetic construct
EVQLVESGGGLVQPGGSLRLSCAASGFNIKDTCIGWVRRAPGKEEELVAAICREAGDTRYADSVKGRFTISADTSKNTAYLQMNSLRAEDTAVYYCAAADYDSTYIYWGQGTTVTVSS

SEQ ID NO: 344 - protein, 117 aa, Artificial Sequence
  Description of Artificial Sequence: Synthetic construct
EVQLVESGGGLVQPGGSLRLSCAASGFNIKDTCIGWVRRAPGKEEELVADICGDDGHTRYADSVKGRFTISADTSKNTAYLQMNSLRAEDTAVYYCAYYSGSYYEYWGQGTTVTVSS

SEQ ID NO: 345 - protein, 119 aa, Artificial Sequence
  Description of Artificial Sequence: Synthetic construct
EVQLVESGGGLVQPGGSLRLSCAASGFNIKDTCIGWVRRAPGKEEELVAGICQHYGDTRYADSVKGRFTISADTSKNTAYLQMNSLRAEDTAVYYCATDDWIYPGYIYWGQGTTVTVSS

SEQ ID NO: 346 - protein, 118 aa, Artificial Sequence
  Description of Artificial Sequence: Synthetic construct
EVQLVESGGGLVQPGGSLRLSCAASGFNIKDTCIGWVRRAPGKEEELVAAICPEYGDTRYADSVKGRFTISADTSKNTAYLQMNSLRAEDTAVYYCASSDYDSAYSYWGQGTTVTVSS

SEQ ID NO: 347 - protein, 356 aa, Artificial Sequence
  Description of Artificial Sequence: Synthetic construct
EVQLVESGGGLVQPGGSLRLSCAASGFNIKDTCIGWVRRAPGKEEELVAYICPSHGYTRYADSVKGRFTISADTSKNTAYLQMNSLRAEDTAVYYCADHKNTQWGYAYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 348 - protein, 355 aa, Artificial Sequence
  Description of Artificial Sequence: Synthetic construct
EVQLVESGGGLVQPGGSLRLSCAASGFNIKDTCIGWVRRAPGKEEELVAAICKTQGDTRYADSVKGRFTISADTSKNTAYLQMNSLRAEDTAVYYCAAANYDSPYTYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 349 - protein, 355 aa, Artificial Sequence
  Description of Artificial Sequence: Synthetic construct
EVQLVESGGGLVQPGGSLRLSCAASGFNIKDTCIGWARRAPGKEEELVAAICDYNGHTRYADSVKGRFTISADTSKNTAYLQMNSLRAEDTAVYYCAQSDYDSKYSYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 350 - protein, 356 aa, Artificial Sequence
  Description of Artificial Sequence: Synthetic construct
EVQLVESGGGLVQPGGSLRLSCAASGFNIKDTCIGWVRRAPGKEEELVAYICEGNGYTRYADSVKGRFTISADTSKNTAYLQMNSLRAEDTAVYYCAAEGKETYYYQYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 351 - protein, 355 aa, Artificial Sequence
  Description of Artificial Sequence: Synthetic construct
EVQLVESGGGLVQPGGSLRLSCAASGFNIKDTCIGWVRRAPGKEEELVAGICRDGGDTRYADSVKGRFTISADTSKNTAYLQMNSLRAEDTAVYYCAASDYDSYYAYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 352 - protein, 356 aa, Artificial Sequence
  Description of Artificial Sequence: Synthetic construct
EVQLVESGGGLVQPGGSLRLSCAASGFNIKDTCIGWVRRAPGKEEELVADICIKHGYTRYADSVKGRFTISADTSKNTAYLQMNSLRAEDTAVYYCADWTQSGYHYGYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 353 - protein, 355 aa, Artificial Sequence
  Description of Artificial Sequence: Synthetic construct
EVQLVESGGGLVQPGGSLRLSCAASGFNIKDTCIGWVRRAPGKEEELVAAICPDEGDTRYADSVKGRFTISADTSKNTAYLQMNSLRAEDTAVYYCAAAKYDDRYNYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 354 - protein, 357 aa, Artificial Sequence
  Description of Artificial Sequence: Synthetic construct
EVQLVESGGGLVQPGGSLRLSCAASGFNIKDSSTYIGWVRRAPGKEEELVAYIYCTQGETRYADSVKGRFTISCDTSKNTAYLQMNSLRAEDTAVYYCASWGGNYPYYYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 355 - protein, 356 aa, Artificial Sequence
  Description of Artificial Sequence: Synthetic construct
EVQLVESGGGLVQPGGSLRLSCAASGFNIKDTCIGWVRRAPGKEEELVARICGEYGSTRYADSVKGRFTISADTSKNTAYLQMNSLRAEDTAVYYCAAQPRYYDVYDYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 356 - protein, 355 aa, Artificial Sequence
  Description of Artificial Sequence: Synthetic construct
EVQLVESGGGLVQPGGSLRLSCAASGFNIKDTCIGWVRRAPGKEEELVAAICYTQGDTRYADSVKGRFTISADTSKNTAYLQMNSLRAEDTAVYYCAASQYDSYYTYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 357 - protein, 355 aa, Artificial Sequence
  Description of Artificial Sequence: Synthetic construct
EVQLVESGGGLVQPGGSLRLSCAASGFNIKDTCIGWVRRAPGKEEELVAGICEAGGDTRYADSVKGRFTISADTSKNTAYLQMNSLRAEDTAVYYCAESQQGSYYSYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 358 - protein, 355 aa, Artificial Sequence
  Description of Artificial Sequence: Synthetic construct
EVQLVESGGGLVQPGGSLRLSCAASGFNIKDTCIGWVRRAPGKEEELVAGICYTYGDTRYADSVKGRFTISADTSKNTAYLQMNSLRAEDTAVYYCASSEVDSYYSYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 359 - protein, 355 aa, Artificial Sequence
  Description of Artificial Sequence: Synthetic construct
EVQLVESGGGLVQPGGSLRLSCAASGFNIKDTCIGWVRRAPGKEEELVAAICDSGGDTRYADSVKGRFTISADTSKNTAYLQMNSLRAEDTAVYYCAASDYNSHYSYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 360 - protein, 355 aa, Artificial Sequence
  Description of Artificial Sequence: Synthetic construct
EVQLVESGGGLVQPGGSLRLSCAASGFNIKDTCIGWVRRAPGKEEELVAAICHHGGDTRYADSVKGRFTISADTSKNTAYLQMNSLRAEDTAVYYCAESQVDSYYSYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 361 - protein, 356 aa, Artificial Sequence
  Description of Artificial Sequence: Synthetic construct
EVQLVESGGGLVQPGGSLRLSCAASGFNIKDTCIGWVRRAPGKEEELVAEICGRYGSTRYADSVKGRFTISADTSKNTAYLQMNSLRAEDTAVYYCAAEHRYPGQYTYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 362 - protein, 355 aa, Artificial Sequence
  Description of Artificial Sequence: Synthetic construct
EVQLVESGGGLVQPGGSLRLSCAASGFNIKDTCIGWVRRAPGKEEELVAAICREAGDTRYADSVKGRFTISADTSKNTAYLQMNSLRAEDTAVYYCAAADYDSTYIYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 363 - protein, 354 aa, Artificial Sequence
  Description of Artificial Sequence: Synthetic construct
EVQLVESGGGLVQPGGSLRLSCAASGFNIKDTCIGWVRRAPGKEEELVADICGDDGHTRYADSVKGRFTISADTSKNTAYLQMNSLRAEDTAVYYCAYYSGSYYEYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 364 - protein, 356 aa, Artificial Sequence
  Description of Artificial Sequence: Synthetic construct
EVQLVESGGGLVQPGGSLRLSCAASGFNIKDTCIGWVRRAPGKEEELVAGICQHYGDTRYADSVKGRFTISADTSKNTAYLQMNSLRAEDTAVYYCATDDWIYPGYIYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 365 - protein, 355 aa, Artificial Sequence
  Description of Artificial Sequence: Synthetic construct
EVQLVESGGGLVQPGGSLRLSCAASGFNIKDTCIGWVRRAPGKEEELVAAICPEYGDTRYADSVKGRFTISADTSKNTAYLQMNSLRAEDTAVYYCASSDYDSAYSYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 366 - DNA, 30 bp, Artificial Sequence
  Description of Artificial Sequence: Synthetic construct
gcaccgggtaaagaagaggaactggttgca

SEQ ID NO: 367 - DNA, 30 bp, Artificial Sequence; identical to SEQ ID NO: 366
  Description of Artificial Sequence: Synthetic construct

SEQ ID NO: 368 - DNA, 30 bp, Artificial Sequence
  Description of Artificial Sequence: Synthetic primer
tgcaaccagttcctcttctttacccggtgc

SEQ ID NO: 369 - DNA, 30 bp, Artificial Sequence
  Description of Artificial Sequence: Synthetic construct
gccgaggacacggccgtatattactgtgcg

SEQ ID NO: 370 - DNA, 30 bp, Artificial Sequence; identical to SEQ ID NO: 369
  Description of Artificial Sequence: Synthetic construct

SEQ ID NO: 371 - DNA, 30 bp, Artificial Sequence; identical to SEQ ID NO: 369
  Description of Artificial Sequence: Synthetic construct

SEQ ID NO: 372 - DNA, 30 bp, Artificial Sequence; identical to SEQ ID NO: 49
  Description of Artificial Sequence: Synthetic construct

SEQ ID NO: 373 - DNA, 30 bp, Artificial Sequence; identical to SEQ ID NO: 16
  Description of Artificial Sequence: Synthetic construct

SEQ ID NO: 374 - DNA, 26 bp, Artificial Sequence
  Description of Artificial Sequence: Synthetic primer
caggaaacagctatgaccatgattac

SEQ ID NO: 375 - protein, 353 aa, Artificial Sequence
  Description of Artificial Sequence: Synthetic construct
EVQLVESGGGLVQPGGSLRLSCAASSFNIKDTYIGWVRRAPGKGTELVAYIQCYGGATRYADSVKGRFTISCDTSKNTAYLQMNSLRAEDTAVYYCAAPSEYFAYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 376 - protein, 353 aa, Artificial Sequence
  Description of Artificial Sequence: Synthetic construct
EVQLQESGGGLVQPGGSLRLSCAASSFNIKDTYIGWVRRAPGKGTELVAYIQCYGGATRYADSVKGRFTISCDTSKNTAYLQMNSLRAEDTAVYYCAAPSEYFAYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 377 - protein, 353 aa, Artificial Sequence
  Description of Artificial Sequence: Synthetic construct
EVQLVESGGGSVQPGGSLRLSCAASSFNIKDTYIGWVRRAPGKGTELVAYIQCYGGATRYADSVKGRFTISCDTSKNTAYLQMNSLRAEDTAVYYCAAPSEYFAYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 378 - protein, 353 aa, Artificial Sequence
  Description of Artificial Sequence: Synthetic construct
EVQLVESGGGLVQPGGSLRLSCAASSYNIKDTYIGWVRRAPGKGTELVAYIQCYGGATRYADSVKGRFTISCDTSKNTAYLQMNSLRAEDTAVYYCAAPSEYFAYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 379 - protein, 353 aa, Artificial Sequence
  Description of Artificial Sequence: Synthetic construct
EVQLVESGGGLVQPGGSLRLSCAASSFNIKDTYIGWVRQAPGKGTELVAYIQCYGGATRYADSVKGRFTISCDTSKNTAYLQMNSLRAEDTAVYYCAAPSEYFAYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 380 - protein, 353 aa, Artificial Sequence
  Description of Artificial Sequence: Synthetic construct
EVQLVESGGGLVQPGGSLRLSCAASSFNIKDTYIGWVRRAPGKETELVAYIQCYGGATRYADSVKGRFTISCDTSKNTAYLQMNSLRAEDTAVYYCAAPSEYFAYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 381 - protein, 353 aa, Artificial Sequence
  Description of Artificial Sequence: Synthetic construct
EVQLVESGGGLVQPGGSLRLSCAASSFNIKDTYIGWVRRAPGKGEELVAYIQCYGGATRYADSVKGRFTISCDTSKNTAYLQMNSLRAEDTAVYYCAAPSEYFAYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 382 - protein, 353 aa, Artificial Sequence
  Description of Artificial Sequence: Synthetic construct
EVQLVESGGGLVQPGGSLRLSCAASSFNIKDTYIGWVRRAPGKGRELVAYIQCYGGATRYADSVKGRFTISCDTSKNTAYLQMNSLRAEDTAVYYCAAPSEYFAYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 383 - protein, 353 aa, Artificial Sequence
  Description of Artificial Sequence: Synthetic construct
EVQLVESGGGLVQPGGSLRLSCAASSFNIKDTYIGWVRRAPGKGTELVAYIQCYGGATYYADSVKGRFTISCDTSKNTAYLQMNSLRAEDTAVYYCAAPSEYFAYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 384 - protein, 353 aa, Artificial Sequence
  Description of Artificial Sequence: Synthetic construct
EVQLVESGGGLVQPGGSLRLSCAASSFNIKDTYIGWVRRAPGKGTELVAYIQCYGGATRYADSVKGRFTISCDTSKNTAYLQMNSLRPEDTAVYYCAAPSEYFAYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 385 - protein, 353 aa, Artificial Sequence
  Description of Artificial Sequence: Synthetic construct
EVQLVESGGGLVQPGGSLRLSCAASSFNIKDTYIGWVRRAPGKGTELVAYIQCYGGATRYADSVKGRFTISCDTSKNTAYLQMNSLRSEDTAVYYCAAPSEYFAYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 386 - protein, 353 aa, Artificial Sequence
  Description of Artificial Sequence: Synthetic construct
EVQLVESGGGLVQPGGSLRLSCAASSFNIKDTYIGWVRRAPGKGTELVAYIQCYGGATRYADSVKGRFTISCDTSKNTAYLQMNSLRAEDTATYYCAAPSEYFAYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 387 - protein, 353 aa, Artificial Sequence
  Description of Artificial Sequence: Synthetic construct
EVQLVESGGGLVQPGGSLRLSCAASSFNIKDTYIGWVRRAPGKGTELVAYIQCYGGATRYADSVKGRFTISCDTSKNTAYLQMNSLRAEDTAVYYCAAPSEYYAYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 388 - protein, 353 aa, Artificial Sequence
  Description of Artificial Sequence: Synthetic construct
EVQLVESGGGLVQPGGSLRLSCAASSFNIKDTYIGWVRRAPGKGTELVAYIQCYGGATRYADSVKGRFTISCDTSKNTAYLQMNSLRAEDTAVYYCAAPSEYFDYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 389 - protein, 353 aa, Artificial Sequence
  Description of Artificial Sequence: Synthetic construct
EVQLVESGGGLVQPGGSLRLSCAASSFNIKDTYIGWVRRAPGKGTELVAYIQCYGGATRYADSVKGRFTISCDTSKNTAYLQMNSLRAEDTAVYYCAAPSEYFAYWGQGTQVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 390 - protein, 353 aa, Artificial Sequence
  Description of Artificial Sequence: Synthetic construct
EVQLQESGGGSVQPGGSLRLSCAASSYNIKDTYIGWVRQAPGKETELVAYIQCYGGATYYADSVKGRFTISCDTSKNTAYLQMNSLRSEDTATYYCAAPSEYYDYWGQGTQVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 391 - protein, 355 aa, Artificial Sequence; identical to SEQ ID NO: 137
  Description of Artificial Sequence: Synthetic construct

SEQ ID NO: 392 - protein, 355 aa, Artificial Sequence
  Description of Artificial Sequence: Synthetic construct
EVQLVESGGGLVQPGGSLRLSCAASGFNIKDTCIGWVRRAPGKGTELVAEICQDIGYTRYADSVKGRFTISADTSKNTAYLQMNSLRAEDTAVYYCAKVEVAEYFDYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 393 - protein, 355 aa, Artificial Sequence
  Description of Artificial Sequence: Synthetic construct
EVQLVESGGGLVQPGGSLRLSCAASGFNIKDTCIGWVRRAPGKEEELVAEICQDIGYTRYADSVKGRFTISADTSKNTAYLQMNSLRAEDTAVYYCAAVEVAEYYEYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 394 - protein, 355 aa, Artificial Sequence
  Description of Artificial Sequence: Synthetic construct
EVQLVESGGGLVQPGGSLRLSCAASGFNIKDTCIGWVRRAPGKEEETVAEICQDIGYTRYADSVKGRFTISADTSKNTAYLQMNSLRAEDTAVYYCAAVEVAEYYEYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 395 - protein, 355 aa, Artificial Sequence
  Description of Artificial Sequence: Synthetic construct
EVQLVESGGGLVQPGGSLRLSCAASGFNIKDTCIGWVRRAPGKERELVAEICQDIGYTRYADSVKGRFTISADTSKNTAYLQMNSLRAEDTAVYYCAAVEVAEYYEYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 396 - protein, 355 aa, Artificial Sequence
  Description of Artificial Sequence: Synthetic construct
EVQLVESGGGLVQPGGSLRLSCAASGFNIKDTCIGWVRRAPGKGTELVAYICAEHGHTRYADSVKGRFTISADTSKNTAYLQMNSLRAEDTAVYYCADTVYADPFEYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 397 - protein, 355 aa, Artificial Sequence
  Description of Artificial Sequence: Synthetic construct
EVQLVESGGGLVQPGGSLRLSCAASGFNIKDTCIGWVRRAPGKGTELVAYICAEHGHTRYADSVKGRFTISADTSKNTAYLQMNSLRAEDTAVYYCAKTVYADPFDYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 398 - protein, 355 aa, Artificial Sequence
  Description of Artificial Sequence: Synthetic construct
EVQLVESGGGLVQPGGSLRLSCAASGFNIKDTCIGWVRRAPGKEEELVAYICAEHGHTRYADSVKGRFTISADTSKNTAYLQMNSLRAEDTAVYYCADTVYADPYEYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 399 - protein, 355 aa, Artificial Sequence
  Description of Artificial Sequence: Synthetic construct
EVQLVESGGGLVQPGGSLRLSCAASGFNIKDTCIGWVRRAPGKEEETVAYICAEHGHTRYADSVKGRFTISADTSKNTAYLQMNSLRAEDTAVYYCADTVYADPYEYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 400 - protein, 355 aa, Artificial Sequence
  Description of Artificial Sequence: Synthetic construct
EVQLVESGGGLVQPGGSLRLSCAASGFNIKDTCIGWVRRAPGKERELVAYICAEHGHTRYADSVKGRFTISADTSKNTAYLQMNSLRAEDTAVYYCADTVYADPYEYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 401 - protein, 355 aa, Artificial Sequence
  Description of Artificial Sequence: Synthetic construct
EVQLVESGGGLVQPGGSLRLSCAASGFNIKDTCIGWVRRAPGKGTELVAEICEDIGYTRYADSVKGRFTISADTSKNTAYLQMNSLRAEDTAVYYCASTEVVTGFSYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 402 - protein, 355 aa, Artificial Sequence
  Description of Artificial Sequence: Synthetic construct
EVQLVESGGGLVQPGGSLRLSCAASGFNIKDTCIGWVRRAPGKGTELVAEICEDIGYTRYADSVKGRFTISADTSKNTAYLQMNSLRAEDTAVYYCAKTEVVTGFDYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 403 - protein, 355 aa, Artificial Sequence
  Description of Artificial Sequence: Synthetic construct
EVQLVESGGGLVQPGGSLRLSCAASGFNIKDTCIGWVRRAPGKEEELVAEICEDIGYTRYADSVKGRFTISADTSKNTAYLQMNSLRAEDTAVYYCASTEVVTGYDYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 404 - protein, 355 aa, Artificial Sequence
  Description of Artificial Sequence: Synthetic construct
EVQLVESGGGLVQPGGSLRLSCAASGFNIKDTCIGWVRRAPGKEEETVAEICEDIGYTRYADSVKGRFTISADTSKNTAYLQMNSLRAEDTAVYYCASTEVVTGYDYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 405 - protein, 355 aa, Artificial Sequence
  Description of Artificial Sequence: Synthetic construct
EVQLVESGGGLVQPGGSLRLSCAASGFNIKDTCIGWVRRAPGKERELVAEICEDIGYTRYADSVKGRFTISADTSKNTAYLQMNSLRAEDTAVYYCASTEVVTGYDYWGQGTTVTVSSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 406 - DNA, 82 bp, Artificial Sequence
  Description of Artificial Sequence: Synthetic primer
  modified_base (31)..(33): This region may encompass one of the following codons: cgt, cgc, cga, cgg, aga, agg, gct, gcc, gca, gcg, aat, aac, act, acc, aca, acg, gat, gac, ggt, ggc, gga, ggg, tat, tac, gaa, gag, caa, cag, tct, tcc, tca, tcg, agt, agc, att, atc, ata, cat, cac, aaa, aag
  modified_base (40)..(42): This region may encompass one of the following codons: cct, ccc, cca, ccg, ggt, ggc, gga, ggg, aat, aac, act, acc, aca, acg, gat, gac, gct, gcc, gca, gcg, cgt, cgc, cga, cgg, aga, agg, aaa, aag, gaa, gag, caa, cag, tat, tac, tct, tcc, tca, tcg, agt, agc, att,
  modified_base (40)..(42): cont. from above: atc, ata, cat, cac
  modified_base (43)..(45): This region may encompass one of the following codons: act, acc, aca, acg, tct, tcc, tca, tcg, agt, agc, aat, aac, ggt, ggc, gga, ggg, gat, gac, gct, gcc, gca, gcg, cgt, cgc, cga, cgg, aga, agg, aaa, aag, gaa, gag, caa, cag, tat, tac, att, atc, ata, cat, cac
  modified_base (46)..(48): This region may encompass one of the following codons: aat, aac, ggt, ggc, gga, ggg, tct, tcc, tca, tcg, agt, agc, act, acc, aca, acg, gat, gac, gct, gcc, gca, gcg, cgt, cgc, cga, cgg, aga, agg, aaa, aag, gaa, gag, caa, cag, tat, tac, att, atc, ata, cat, cac
  modified_base (52)..(54): This region may encompass one of the following codons: tct, tcc, tca, tcg, agt, agc, tat, tac, aat, aac, act, acc, aca, acg, gat, gac, gct, gcc, gca, gcg, cgt, cgc, cga, cgg, aga, agg, aaa, aag, gaa, gag, caa, cag, ggt, ggc, gga, ggg, att, atc, ata, cat, cac
  See specification as filed for detailed description of substitutions and preferred embodiments
gcaccgggtaaagaagaggaactggttgcannnatttgtnnnnnnnnnggtnnnacccgttatgcagatagcgtgaaaggtc

SEQ ID NO: 407 - DNA, 82 bp, Artificial Sequence
  Description of Artificial Sequence: Synthetic primer
  modified_base (31)..(33): This region may encompass one of the following codons: cgt, cgc, cga, cgg, aga, agg, gct, gcc, gca, gcg, aat, aac, act, acc, aca, acg, gat, gac, ggt, ggc, gga, ggg, tat, tac, gaa, gag, caa, cag, tct, tcc, tca, tcg, agt, agc, att, atc, ata, cat, cac, aaa, aag
  modified_base (37)..(39): This region may encompass one of the following codons: tat, tac, tct, tcc, tca, tcg, agt, agc, aat, aac, gct, gcc, gca, gcg, gat, gac, ggt, ggc, gga, ggg, cgt, cgc, cga, cgg, aga, agg, aaa, aag, gaa, gag, caa, cag, act, acc, aca, acg, att, atc, ata, cat, cac
  modified_base (43)..(45): This region may encompass one of the following codons: act, acc, aca, acg, tct, tcc, tca, tcg, agt, agc, aat, aac, ggt, ggc, gga, ggg, gat, gac, gct, gcc, gca, gcg, cgt, cgc, cga, cgg, aga, agg, aaa, aag, gaa, gag, caa, cag, tat, tac, att, atc, ata, cat, cac
  modified_base (46)..(48): This region may encompass one of the following codons: aat, aac, ggt, ggc, gga, ggg, tct, tcc, tca, tcg, agt, agc, act, acc, aca, acg, gat, gac, gct, gcc, gca, gcg, cgt, cgc, cga, cgg, aga, agg, aaa, aag, gaa, gag, caa, cag, tat, tac, att, atc, ata, cat, cac
  modified_base (52)..(54): This region may encompass one of the following codons: tct, tcc, tca, tcg, agt, agc, tat, tac, aat, aac, act, acc, aca, acg, gat, gac, gct, gcc, gca, gcg, cgt, cgc, cga, cgg, aga, agg, aaa, aag, gaa, gag, caa, cag, ggt, ggc, gga, ggg, att, atc, ata, cat, cac
  See specification as filed for detailed description of substitutions and preferred embodiments
gcaccgggtaaagaagaggaactggttgcannnattnnntgcnnnnnnggtnnnacccgttatgcagatagcgtgaaaggtc

SEQ ID NO: 408 - DNA, 84 bp, Artificial Sequence
  Description of Artificial Sequence: Synthetic primer
  modified_base (31)..(33): This region may encompass one of the following codons: gct, gcc, gca, gcg, tct, tcc, tca, tcg, agt, agc, aat, aac, act, acc, aca, acg, gat, gac, cgt, cgc, cga, cgg, aga, agg, tat, tac, aaa, aag, gaa, gag, caa, cag, ggt, ggc, gga, ggg, att, atc, ata, cat, cac
  modified_base (34)..(36): This region may encompass one of the following codons: ggt, ggc, gga, ggg, tat, tac, tct, tcc, tca, tcg, agt, agc, gat, gac, gaa, gag, caa, cag, aat, aac, gct, gcc, gca, gcg, att, atc, ata, gtt, gtc, gta, gtg, cat, cac, cct, ccc, cca, ccg, cgt, cgc, cga, cgg,
  modified_base (34)..(36): cont. from above: aga, agg, aaa, aag, act, acc, aca, acg, tgg
  modified_base (37)..(39): This region may encompass one of the following codons: ggt, ggc, gga, ggg, tat, tac, tct, tcc, tca, tcg, agt, agc, gat, gac, gaa, gag, caa, cag, aat, aac, gct, gcc, gca, gcg, att, atc, ata, gtt, gtc, gta, gtg, cat, cac, cct, ccc, cca, ccg, cgt, cgc, cga, cgg,
  modified_base (37)..(39): cont. from above: aga, agg, aaa, aag, act, acc, aca, acg, tgg
  modified_base (40)..(42): This region may encompass one of the following codons: ggt, ggc, gga, ggg, tat, tac, tct, tcc, tca, tcg, agt, agc, gat, gac, gaa, gag, caa, cag, aat, aac, gct, gcc, gca, gcg, att, atc, ata, gtt, gtc, gta, gtg, cat, cac, cct, ccc, cca, ccg, cgt, cgc, cga, cgg,
  modified_base (40)..(42): cont. from above: aga, agg, aaa, aag, act, acc, aca, acg, tgg
  modified_base (43)..(45): This region may encompass one of the following codons: ggt, ggc, gga, ggg, tat, tac, tct, tcc, tca, tcg, agt, agc, gat, gac, gaa, gag, caa, cag, aat, aac, gct, gcc, gca, gcg, att, atc, ata, gtt, gtc, gta, gtg, cat, cac, cct, ccc, cca, ccg, cgt, cgc, cga, cgg,
  modified_base (43)..(45): cont. from above: aga, agg, aaa, aag, act, acc, aca, acg, tgg
  modified_base (46)..(48): This region may encompass one of the following codons: ggt, ggc, gga, ggg, tat, tac, tct, tcc, tca, tcg, agt, agc, gat, gac, gaa, gag, caa, cag, aat, aac, gct, gcc, gca, gcg, att, atc, ata, gtt, gtc, gta, gtg, cat, cac, cct, ccc, cca, ccg, cgt, cgc, cga, cgg,
  modified_base (46)..(48): cont. from above: aga, agg, aaa, aag, act, acc, aca, acg, tgg
  modified_base (52)..(54): This region may encompass one of the following codons: gat, gac, aat, aac, act, acc, aca, acg, tct, tcc, tca, tcg, agt, agc, gct, gcc, gca, gcg, cgt, cgc, cga, cgg, aga, agg, aaa, aag, gaa, gag, caa, cag, ggt, ggc, gga, ggg, att, atc, ata, tat, tac
  See specification as filed for detailed description of substitutions and preferred embodiments
gccgaggacacggccgtatattactgtgcgnnnnnnnnnnnnnnnnnntacnnntactgggggcaaggaaccaccgtcaccgtc

SEQ ID NO: 409 - DNA, 87 bp, Artificial Sequence
  Description of Artificial Sequence: Synthetic primer
  modified_base (31)..(33): This region may encompass one of the following codons: gct, gcc, gca, gcg, tct, tcc, tca, tcg, agt, agc, aat, aac, act, acc, aca, acg, gat, gac, cgt, cgc, cga, cgg, aga, agg, tat, tac, aaa, aag, gaa, gag, caa, cag, ggt, ggc, gga, ggg, att, atc, ata, cat, cac
  modified_base (34)..(36): This region may encompass one of the following codons: ggt, ggc, gga, ggg, tat, tac, tct, tcc, tca, tcg, agt, agc, gat, gac, gaa, gag, caa, cag, aat, aac, gct, gcc, gca, gcg, att, atc, ata, gtt, gtc, gta, gtg, cat, cac, cct, ccc, cca, ccg, cgt, cgc, cga, cgg,
  modified_base (34)..(36): cont. from above: aga, agg, aaa, aag, act, acc, aca, acg, tgg
  modified_base (37)..(39): This region may encompass one of the following codons: ggt, ggc, gga, ggg, tat, tac, tct, tcc, tca, tcg, agt, agc, gat, gac, gaa, gag, caa, cag, aat, aac, gct, gcc, gca, gcg, att, atc, ata, gtt, gtc, gta, gtg, cat, cac, cct, ccc, cca, ccg, cgt, cgc, cga, cgg,
  modified_base (37)..(39): cont. from above: aga, agg, aaa, aag, act, acc, aca, acg, tgg
  modified_base (40)..(42): This region may encompass one of the following codons: ggt, ggc, gga, ggg, tat, tac, tct, tcc, tca, tcg, agt, agc, gat, gac, gaa, gag, caa, cag, aat, aac, gct, gcc, gca, gcg, att, atc, ata, gtt, gtc, gta, gtg, cat, cac, cct, ccc, cca, ccg, cgt, cgc, cga, cgg,
  modified_base (40)..(42): cont. from above: aga, agg, aaa, aag, act, acc, aca, acg, tgg
  modified_base (43)..(45): This region may encompass one of the following codons: ggt, ggc, gga, ggg, tat, tac, tct, tcc, tca, tcg, agt, agc, gat, gac, gaa, gag, caa, cag, aat, aac, gct, gcc, gca, gcg, att, atc, ata, gtt, gtc, gta, gtg, cat, cac, cct, ccc, cca, ccg, cgt, cgc, cga, cgg,
  modified_base (43)..(45): cont. from above: aga, agg, aaa, aag, act, acc, aca, acg, tgg
  modified_base (46)..(48): This region may encompass one of the following codons: ggt, ggc, gga, ggg, tat, tac, tct, tcc, tca, tcg, agt, agc, gat, gac, gaa, gag, caa, cag, aat, aac, gct, gcc, gca, gcg, att, atc, ata, gtt, gtc, gta, gtg, cat, cac, cct, ccc, cca, ccg, cgt, cgc, cga, cgg,
  modified_base (46)..(48): cont. from above: aga, agg, aaa, aag, act, acc, aca, acg, tgg
  modified_base (49)..(51): This region may encompass one of the following codons: ggt, ggc, gga, ggg, tat, tac, tct, tcc, tca, tcg, agt, agc, gat, gac, gaa, gag, caa, cag, aat, aac, gct, gcc, gca, gcg, att, atc, ata, gtt, gtc, gta, gtg, cat, cac, cct, ccc, cca, ccg, cgt, cgc, cga, cgg,
  modified_base (49)..(51): cont. from above: aga, agg, aaa, aag, act, acc, aca, acg, tgg
  modified_base (55)..(57): This region may encompass one of the following codons: gat, gac, aat, aac, act, acc, aca, acg, tct, tcc, tca, tcg, agt, agc, gct, gcc, gca, gcg, cgt, cgc, cga, cgg, aga, agg, aaa, aag, gaa, gag, caa, cag, ggt, ggc, gga, ggg, att, atc, ata, tat, tac
  See specification as filed for detailed description of substitutions and preferred embodiments
gccgaggacacggccgtatattactgtgcgnnnnnnnnnnnnnnnnnnnnntacnnntactgggggcaaggaaccaccgtcaccgtc

SEQ ID NO: 410 - DNA, 90 bp, Artificial Sequence
  Description of Artificial Sequence: Synthetic primer
  modified_base (31)..(33): This region may encompass one of the following codons: gct, gcc, gca, gcg, tct, tcc, tca, tcg, agt, agc, aat, aac, act, acc, aca, acg, gat, gac, cgt, cgc, cga, cgg, aga, agg, tat, tac, aaa, aag, gaa, gag, caa, cag, ggt, ggc, gga, ggg, att, atc, ata, cat, cac
  modified_base (34)..(36): This region may encompass one of the following codons: ggt, ggc, gga, ggg, tat, tac, tct, tcc, tca, tcg, agt, agc, gat, gac, gaa, gag, caa, cag, aat, aac, gct, gcc, gca, gcg, att, atc, ata, gtt, gtc, gta, gtg, cat, cac, cct, ccc, cca, ccg, cgt, cgc, cga, cgg,
  modified_base (34)..(36): cont. from above: aga, agg, aaa, aag, act, acc, aca, acg, tgg
  modified_base (37)..(39): This region may encompass one of the following codons: ggt, ggc, gga, ggg, tat, tac, tct, tcc, tca, tcg, agt, agc, gat, gac, gaa, gag, caa, cag, aat, aac, gct, gcc, gca, gcg, att, atc, ata, gtt, gtc, gta, gtg, cat, cac, cct, ccc, cca, ccg, cgt, cgc, cga, cgg,
  modified_base (37)..(39): cont. from above: aga, agg, aaa, aag, act, acc, aca, acg, tgg
  modified_base (40)..(42): This region may encompass one of the following codons: ggt, ggc, gga, ggg, tat, tac, tct, tcc, tca, tcg, agt, agc, gat, gac, gaa, gag, caa, cag, aat, aac, gct, gcc, gca, gcg, att, atc, ata, gtt, gtc, gta, gtg, cat, cac, cct, ccc, cca, ccg, cgt, cgc, cga, cgg,
  modified_base (40)..(42): cont. from above: aga, agg, aaa, aag, act, acc, aca, acg, tgg
  modified_base (43)..(45): This region may encompass one of the following codons: ggt, ggc, gga, ggg, tat, tac, tct, tcc, tca, tcg, agt, agc, gat, gac, gaa, gag, caa, cag, aat, aac, gct, gcc, gca, gcg, att, atc, ata, gtt, gtc, gta, gtg, cat, cac, cct, ccc, cca, ccg, cgt, cgc, cga, cgg,
  modified_base (43)..(45): cont. from above: aga, agg, aaa, aag, act, acc, aca, acg, tgg
  modified_base (46)..(48): This region may encompass one of the following codons: ggt, ggc, gga, ggg, tat, tac, tct, tcc, tca, tcg, agt, agc, gat, gac, gaa, gag, caa, cag, aat, aac, gct, gcc, gca, gcg, att, atc, ata, gtt, gtc, gta, gtg, cat, cac, cct, ccc, cca, ccg, cgt, cgc, cga, cgg,
  modified_base (46)..(48): cont. from above: aga, agg, aaa, aag, act, acc, aca, acg, tgg
  modified_base (49)..(51): This region may encompass one of the following codons: ggt, ggc, gga, ggg, tat, tac, tct, tcc, tca, tcg, agt, agc, gat, gac, gaa, gag, caa, cag, aat, aac, gct, gcc, gca, gcg, att, atc, ata, gtt, gtc, gta, gtg, cat, cac, cct, ccc, cca, ccg, cgt, cgc, cga, cgg,
  modified_base (49)..(51): cont. from above: aga, agg, aaa, aag, act, acc, aca, acg, tgg
  modified_base (52)..(54): This region may encompass one of the following codons: ggt, ggc, gga, ggg, tat, tac, tct, tcc, tca, tcg, agt, agc, gat, gac, gaa, gag, caa, cag, aat, aac, gct, gcc, gca, gcg, att, atc, ata, gtt, gtc, gta, gtg, cat, cac, cct, ccc, cca, ccg, cgt, cgc, cga, cgg,
  modified_base (52)..(54): cont. from above: aga, agg, aaa, aag, act, acc, aca, acg, tgg
  modified_base (58)..(60): This region may encompass one of the following codons: gat, gac, aat, aac, act, acc, aca, acg, tct, tcc, tca, tcg, agt, agc, gct, gcc, gca, gcg, cgt, cgc, cga, cgg, aga, agg, aaa, aag, gaa, gag, caa, cag, ggt, ggc, gga, ggg, att, atc, ata, tat, tac
  See specification as filed for detailed description of substitutions and preferred embodiments
gccgaggacacggccgtatattactgtgcgnnnnnnnnnnnnnnnnnnnnnnnntacnnntactgggggcaaggaaccaccgtcaccgtc

SEQ ID NO: 411 - protein, 10 aa, Artificial Sequence
  Description of Artificial Sequence: Synthetic peptide
GGGGSGGGGS

SEQ ID NO: 412 - protein, 15 aa, Artificial Sequence
  Description of Artificial Sequence: Synthetic peptide
DGGSPTPPTPGGGSA

SEQ ID NO: 413 - protein, 5 aa, Artificial Sequence
  Description of Artificial Sequence: Synthetic peptide
GGGGS

SEQ ID NO: 414 - protein, 50 aa, Artificial Sequence
  Description of Artificial Sequence: Synthetic polypeptide
  MISC_FEATURE (1)..(50): This sequence may encompass 1-10 "Gly Gly Gly Gly Ser" repeating units
  See specification as filed for detailed description of substitutions and preferred embodiments
GGGGSGGGGSGGGGSGGGGSGGGGSGGGGSGGGGSGGGGSGGGGSGGGGS

SEQ ID NO: 415 - protein, 50 aa, Artificial Sequence
  Description of Artificial Sequence: Synthetic polypeptide
  MISC_FEATURE (1)..(50): This sequence may encompass 1-10 "Ser Gly Gly Gly Gly" repeating units
  See specification as filed for detailed description of substitutions and preferred embodiments
SGGGGSGGGGSGGGGSGGGGSGGGGSGGGGSGGGGSGGGGSGGGGSGGGG

SEQ ID NO: 416 - protein, 54 aa, Artificial Sequence
  Description of Artificial Sequence: Synthetic polypeptide
  MISC_FEATURE (5)..(54): This region may encompass 1-10 "Ser Gly Gly Gly Gly" repeating units
  See specification as filed for detailed description of substitutions and preferred embodiments
GGGGSGGGGSGGGGSGGGGSGGGGSGGGGSGGGGSGGGGSGGGGSGGGGSGGGG

SEQ ID NO: 417 - protein, 17 aa, Artificial Sequence
  Description of Artificial Sequence: Synthetic peptide
GSGLNDIFEAQKIEWHE

SEQ ID NO: 418 - protein, 15 aa, Artificial Sequence
  Description of Artificial Sequence: Synthetic peptide
GLNDIFEAQKIEWHE

SEQ ID NO: 419 - protein, 120 aa, Artificial Sequence [sequence omitted]

SEQ ID NO: 420 - protein, 28 aa, Artificial Sequence
  Description of Artificial Sequence: Synthetic peptide
  MOD_RES (10)..(15): Any amino acid
  See specification as filed for detailed description of substitutions and preferred embodiments
EDTAVYYCAXXXXXXDYWGQGTLVTVSS

SEQ ID NO: 421 - protein, 30 aa, Artificial Sequence
  Description of Artificial Sequence: Synthetic polypeptide
  MOD_RES (10)..(17): Any amino acid
  See specification as filed for detailed description of substitutions and preferred embodiments
EDTAVYYCAXXXXXXXXDYWGQGTLVTVSS

SEQ ID NO: 422 - protein, 32 aa, Artificial Sequence
  Description of Artificial Sequence: Synthetic polypeptide
  MOD_RES (10)..(19): Any amino acid
  See specification as filed for detailed description of substitutions and preferred embodiments
EDTAVYYCAXXXXXXXXXXDYWGQGTLVTVSS

SEQ ID NO: 423 - protein, 116 aa, Artificial Sequence
  Description of Artificial Sequence: Synthetic polypeptide
EVQLVESGGGLVQPGGSLRLSCAASSFNIKDTYIGWVRRAPGKGTELVAYIQCYGGATRYADSVKGRFTISCDTSKNTAYLQMNSLRAEDTAVYYCAAPSEYFAYWGQGTTVTVSS

SEQ ID NO: 424 - protein, 116 aa, Artificial Sequence
  Description of Artificial Sequence: Synthetic polypeptide
EVQLQESGGGLVQPGGSLRLSCAASSFNIKDTYIGWVRRAPGKGTELVAYIQCYGGATRYADSVKGRFTISCDTSKNTAYLQMNSLRAEDTAVYYCAAPSEYFAYWGQGTTVTVSS

SEQ ID NO: 425 - protein, 116 aa, Artificial Sequence
  Description of Artificial Sequence: Synthetic polypeptide
EVQLVESGGGSVQPGGSLRLSCAASSFNIKDTYIGWVRRAPGKGTELVAYIQCYGGATRYADSVKGRFTISCDTSKNTAYLQMNSLRAEDTAVYYCAAPSEYFAYWGQGTTVTVSS

SEQ ID NO: 426 - protein, 116 aa, Artificial Sequence
  Description of Artificial Sequence: Synthetic polypeptide
EVQLVESGGGLVQPGGSLRLSCAASSYNIKDTYIGWVRRAPGKGTELVAYIQCYGGATRYADSVKGRFTISCDTSKNTAYLQMNSLRAEDTAVYYCAAPSEYFAYWGQGTTVTVSS

SEQ ID NO: 427 - protein, 116 aa, Artificial Sequence
  Description of Artificial Sequence: Synthetic polypeptide
EVQLVESGGGLVQPGGSLRLSCAASSFNIKDTYIGWVRQAPGKGTELVAYIQCYGGATRYADSVKGRFTISCDTSKNTAYLQMNSLRAEDTAVYYCAAPSEYFAYWGQGTTVTVSS

SEQ ID NO: 428 - protein, 116 aa, Artificial Sequence
  Description of Artificial Sequence: Synthetic polypeptide
EVQLVESGGGLVQPGGSLRLSCAASSFNIKDTYIGWVRRAPGKETELVAYIQCYGGATRYADSVKGRFTISCDTSKNTAYLQMNSLRAEDTAVYYCAAPSEYFAYWGQGTTVTVSS

SEQ ID NO: 429 - protein, 116 aa, Artificial Sequence
  Description of Artificial Sequence: Synthetic polypeptide
EVQLVESGGGLVQPGGSLRLSCAASSFNIKDTYIGWVRRAPGKGEELVAYIQCYGGATRYADSVKGRFTISCDTSKNTAYLQMNSLRAEDTAVYYCAAPSEYFAYWGQGTTVTVSS

SEQ ID NO: 430 - protein, 116 aa, Artificial Sequence
  Description of Artificial Sequence: Synthetic polypeptide
EVQLVESGGGLVQPGGSLRLSCAASSFNIKDTYIGWVRRAPGKGRELVAYIQCYGGATRYADSVKGRFTISCDTSKNTAYLQMNSLRAEDTAVYYCAAPSEYFAYWGQGTTVTVSS

SEQ ID NO: 431 - protein, 116 aa, Artificial Sequence
  Description of Artificial Sequence: Synthetic polypeptide
EVQLVESGGGLVQPGGSLRLSCAASSFNIKDTYIGWVRRAPGKGTELVAYIQCYGGATYYADSVKGRFTISCDTSKNTAYLQMNSLRAEDTAVYYCAAPSEYFAYWGQGTTVTVSS

SEQ ID NO: 432 - protein, 116 aa, Artificial Sequence
  Description of Artificial Sequence: Synthetic polypeptide
EVQLVESGGGLVQPGGSLRLSCAASSFNIKDTYIGWVRRAPGKGTELVAYIQCYGGATRYADSVKGRFTISCDTSKNTAYLQMNSLRPEDTAVYYCAAPSEYFAYWGQGTTVTVSS

SEQ ID NO: 433 - protein, 116 aa, Artificial Sequence
  Description of Artificial Sequence: Synthetic polypeptide
EVQLVESGGGLVQPGGSLRLSCAASSFNIKDTYIGWVRRAPGKGTELVAYIQCYGGATRYADSVKGRFTISCDTSKNTAYLQMNSLRSEDTAVYYCAAPSEYFAYWGQGTTVTVSS

SEQ ID NO: 434 - protein, 116 aa, Artificial Sequence
  Description of Artificial Sequence: Synthetic polypeptide
EVQLVESGGGLVQPGGSLRLSCAASSFNIKDTYIGWVRRAPGKGTELVAYIQCYGGATRYADSVKGRFTISCDTSKNTAYLQMNSLRAEDTATYYCAAPSEYFAYWGQGTTVTVSS

SEQ ID NO: 435 - protein, 116 aa, Artificial Sequence
  Description of Artificial Sequence: Synthetic polypeptide
EVQLVESGGGLVQPGGSLRLSCAASSFNIKDTYIGWVRRAPGKGTELVAYIQCYGGATRYADSVKGRFTISCDTSKNTAYLQMNSLRAEDTAVYYCAAPSEYYAYWGQGTTVTVSS

SEQ ID NO: 436 - protein, 116 aa, Artificial Sequence
  Description of Artificial Sequence: Synthetic polypeptide
EVQLVESGGGLVQPGGSLRLSCAASSFNIKDTYIGWVRRAPGKGTELVAYIQCYGGATRYADSVKGRFTISCDTSKNTAYLQMNSLRAEDTAVYYCAAPSEYFDYWGQGTTVTVSS

SEQ ID NO: 437 - protein, 116 aa, Artificial Sequence
  Description of Artificial Sequence: Synthetic polypeptide
EVQLVESGGGLVQPGGSLRLSCAASSFNIKDTYIGWVRRAPGKGTELVAYIQCYGGATRYADSVKGRFTISCDTSKNTAYLQMNSLRAEDTAVYYCAAPSEYFAYWGQGTQVTVSS

SEQ ID NO: 438 - protein, 116 aa, Artificial Sequence
  Description of Artificial Sequence: Synthetic polypeptide
EVQLQESGGGSVQPGGSLRLSCAASSYNIKDTYIGWVRQAPGKETELVAYIQCYGGATYYADSVKGRFTISCDTSKNTAYLQMNSLRSEDTATYYCAAPSEYYDYWGQGTQVTVSS

SEQ ID NO: 439 - protein, 119 aa, Artificial Sequence
  Description of Artificial Sequence: Synthetic polypeptide
  MOD_RES (50)..(50): Any amino acid
  MOD_RES (53)..(55): Any amino acid
  MOD_RES (57)..(57): Any amino acid
  MOD_RES (98)..(105): Any amino acid
  MISC_FEATURE (98)..(105): This region may encompass 6-8 residues
  MOD_RES (107)..(107): Any amino acid
EVQLVESGGGLVQPGGSLRLSCAASGFNIKDTCIGWVRRAPGKEEELVAXICXXXGXTRYADSVKGRFTISADTSKNTAYLQMNSLRAEDTAVYYCAXXXXXXXXYXYWGQGTTVTVSS

SEQ ID NO: 440 - protein, 121 aa, Artificial Sequence
  Description of Artificial Sequence: Synthetic polypeptide
  MOD_RES (52)..(52): Any amino acid
  MOD_RES (54)..(54): Any amino acid
  MOD_RES (56)..(57): Any amino acid
  MOD_RES (59)..(59): Any amino acid
  MOD_RES (100)..(107): Any amino acid
  MISC_FEATURE (100)..(107): This region may encompass 6-8 residues
  MOD_RES (109)..(109): Any amino acid
EVQLVESGGGLVQPGGSLRLSCAASGFNIKDSSTYIGWVRRAPGKEEELVAXIXCXXGXTRYADSVKGRFTISCDTSKNTAYLQMNSLRAEDTAVYYCAXXXXXXXXYXYWGQGTTVTVSS

SEQ ID NO: 441 - protein, 119 aa, Artificial Sequence
  Description of Artificial Sequence: Synthetic polypeptide
  MOD_RES (50)..(50): Any amino acid
  MOD_RES (52)..(52): Any amino acid
  MOD_RES (54)..(55): Any amino acid
  MOD_RES (57)..(57): Any amino acid
  MOD_RES (98)..(105): Any amino acid
  MISC_FEATURE (98)..(105): This region may encompass 6-8 residues
  MOD_RES (107)..(107): Any amino acid
EVQLVESGGGLVQPGGSLRLSCAASSFNIKDTYIGWVRRAPGKEEELVAXIXCXXGXTRYADSVKGRFTISCDTSKNTAYLQMNSLRAEDTAVYYCAXXXXXXXXYXYWGQGTTVTVSS

SEQ ID NO: 442 - protein, 6 aa, Artificial Sequence
  Description of Artificial Sequence: Synthetic peptide
IEGRMD

The invention claimed is:

1. An autonomous VH domain with cysteines in positions (i) 52a and 71 or (ii) 33 and 52 according to Kabat numbering, wherein said cysteines form a disulfide bond under oxidative conditions, comprising a heavy chain variable domain framework comprising a
   (a) FR1 comprising at least 95% sequence identity to the amino acid sequence of SEQ ID NO: 207,
   (b) FR2 comprising at least 95% sequence identity to the amino acid sequence of SEQ ID NO: 208,
   (c) FR3 comprising at least 95% sequence identity to the amino acid sequence of SEQ ID NO: 209, and
   (d) FR4 comprising at least 95% sequence identity to the amino acid sequence of SEQ ID NO: 210;
   or
   (a) FR1 comprising at least 95% sequence identity to the amino acid sequence of SEQ ID NO: 211,
   (b) FR2 comprising at least 95% sequence identity to the amino acid sequence of SEQ ID NO: 208,
   (c) FR3 comprising at least 95% sequence identity to the amino acid sequence of SEQ ID NO: 209, and
   (d) FR4 comprising at least 95% sequence identity to the amino acid sequence of SEQ ID NO: 210.

2. The autonomous VH domain of claim 1 comprising a substitution selected from the group consisting of 44E, 45E and (101-1) Y according to Kabat numbering.

3. The autonomous VH domain of claim 2 comprising the substitutions 44E, 45E, and (101-1) Y according to Kabat numbering.

4. The autonomous VH domain of claim 1 comprising a substitution selected from the group consisting of G44E, T45E and F(101-1)Y according to Kabat numbering.

5. The autonomous VH domain of claim 4 comprising the substitutions G44E, T45E, and F(101-1)Y according to Kabat numbering.

6. An automous VH domain of claim 1 comprising at least 95% sequence identity to the amino acid sequence of SEQ ID NO: 40, or SEQ ID NO: 42, or SEQ ID NO: 44, SEQ ID NO: 46, or SEQ ID: NO 180.

7. An autonomous VH domain of claim 1 comprising the sequence of SEQ ID NO: 40, or SEQ ID NO: 42, or SEQ ID NO: 44, SEQ ID NO: 46, or SEQ ID NO: 180.

8. The autonomous VH domain of claim 1, wherein the autonomous VH domain binds to death receptor 5 (DR5), or melanoma-associated chondroitin sulfate proteoglycan (MCSP), or transferrin receptor 1 (TfR1), or lymphocyte-activation gene 3 (LAG3), or fibroblast activation protein (FAP), or carcinoembryonic antigen (CEA), or CD28.

9. The autonomous VH domain of claim 8,
   (A) wherein the autonomous VH domain binds to MCSP and comprises an amino acid sequence selected from the group consisting of SEQ ID NO: 57, SEQ ID NO: 59, SEQ ID NO: 61, SEQ ID NO: 63, and SEQ ID NO: 65;

or (B) wherein the autonomous VH domain binds to TfR1 and comprises an amino acid sequence selected from the group consisting of the amino acid sequence of SEQ ID NO: 194, the sequence of SEQ ID NO: 195, the amino acid sequence of SEQ ID NO: 196, the amino acid sequence of SEQ ID NO: 197, the amino acid sequence of SEQ ID NO: 198, the amino acid sequence of SEQ ID NO: 199, and the amino acid sequence of SEQ ID NO: 200;

or (C) wherein the autonomous VH domain binds to LAG3 and comprises an amino acid sequence selected from the group consisting of SEQ ID NO: 77, SEQ ID NO: 79, SEQ ID NO: 81, SEQ ID NO: 83, SEQ ID NO: 85 SEQ, ID NO: 87, SEQ ID NO: 89, SEQ ID NO: 91, SEQ ID NO: 93, SEQ ID NO: 95, and SEQ ID NO: 97 or (D) wherein the autonomous VH domain binds to FAP and comprises an amino acid sequence selected from the group consisting of SEQ ID NO: 260, SEQ ID NO: 261, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, and SEQ ID NO: 279;

or (E) wherein the autonomous VH domain binds to CEA and comprises an amino acid sequence selected from the group consisting of SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, and SEQ ID NO: 313;

or (F) wherein the autonomous VH domain binds to CD28 and comprises an amino acid sequence selected from the group consisting of SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344, SEQ ID NO: 345, and SEQ ID NO: 346.

10. The autonomous VH domain of claim 1, wherein the autonomous VH domain comprises a VH3_23 human framework.

* * * * *